(12) United States Patent
Sugiyama

(10) Patent No.: US 10,093,977 B2
(45) Date of Patent: Oct. 9, 2018

(54) CANCER ANTIGEN-SPECIFIC T-CELL RECEPTOR GENE, PEPTIDE ENCODED BY THE GENE, AND USE OF THEM

(75) Inventor: Haruo Sugiyama, Minoo (JP)

(73) Assignee: International Institute of Cancer Immunology, Inc., Osaka (JP)

( * ) Notice: Subject to any disclaimer, the term of this patent is extended or adjusted under 35 U.S.C. 154(b) by 0 days.

(21) Appl. No.: 12/529,701

(22) PCT Filed: Feb. 28, 2008

(86) PCT No.: PCT/JP2008/053469
§ 371 (c)(1),
(2), (4) Date: Mar. 26, 2010

(87) PCT Pub. No.: WO2008/108257
PCT Pub. Date: Sep. 12, 2008

(65) Prior Publication Data
US 2010/0190163 A1 Jul. 29, 2010

(30) Foreign Application Priority Data
Mar. 5, 2007 (JP) .................................. 2007-054215

(51) Int. Cl.
| C07H 21/04 | (2006.01) |
| C12Q 1/6881 | (2018.01) |
| C07K 14/725 | (2006.01) |
| C12Q 1/6886 | (2018.01) |
| G01N 33/569 | (2006.01) |
| G01N 33/574 | (2006.01) |

(52) U.S. Cl.
CPC ........ *C12Q 1/6881* (2013.01); *C07K 14/7051* (2013.01); *C12Q 1/6886* (2013.01); *G01N 33/56977* (2013.01); *G01N 33/57492* (2013.01); *C12Q 2600/106* (2013.01); *C12Q 2600/156* (2013.01); *C12Q 2600/16* (2013.01)

(58) Field of Classification Search
None
See application file for complete search history.

(56) References Cited

U.S. PATENT DOCUMENTS

| 4,923,799 A | 5/1990 | Mak |
| 5,512,478 A | 4/1996 | Orser et al. |
| 6,225,051 B1 | 5/2001 | Sugiyama |
| 6,582,908 B2 * | 6/2003 | Fodor et al. ............ 506/9 |
| 2002/0131960 A1 | 9/2002 | Sadelain et al. |
| 2004/0097703 A1 | 5/2004 | Sugiyama |
| 2004/0247609 A1 | 12/2004 | Sugiyama |
| 2005/0002951 A1 | 1/2005 | Sugiyama et al. |
| 2005/0266014 A1 | 12/2005 | Sugiyama et al. |
| 2006/0035291 A1 | 2/2006 | Itoh et al. |
| 2007/0082860 A1 | 4/2007 | Sugiyama et al. |
| 2007/0238099 A1 | 10/2007 | Cohen et al. |
| 2008/0070835 A1 | 3/2008 | Sugiyama |
| 2008/0152631 A1 | 6/2008 | Sugiyama |
| 2009/0099090 A1 | 4/2009 | Sugiyama et al. |
| 2014/0255941 A1 | 9/2014 | Sugiyama |

FOREIGN PATENT DOCUMENTS

| EP | 1447091 A1 | 8/2001 |
| EP | 1410804 A1 | 4/2004 |
| EP | 1473564 A1 | 11/2004 |
| EP | 1536009 A1 | 6/2005 |
| EP | 1550453 A1 | 7/2005 |
| EP | 1640458 A1 | 3/2006 |
| JP | A2001-517958 | 10/2001 |
| JP | A2002-515243 | 5/2002 |
| JP | 2002-525099 | 8/2002 |
| JP | 2003-500004 | 1/2003 |
| JP | 2009-278927 A | 12/2009 |
| KR | 10-2002-0013503 | 2/2002 |
| WO | WO-93-04695 A1 | 3/1993 |
| WO | WO 1998/054223 A2 | 12/1998 |
| WO | WO 1999/027957 A1 | 6/1999 |
| WO | WO-99-60119 A2 | 11/1999 |
| WO | WO 1999/060119 A2 | 11/1999 |
| WO | WO-00-018795 | 4/2000 |
| WO | WO-00-26249 | 5/2000 |
| WO | WO 00/50641 | 8/2000 |
| WO | WO-02-28414 | 4/2002 |
| WO | WO-02-079253 | 10/2002 |
| WO | WO-03-002142 | 1/2003 |
| WO | WO-03-025569 | 3/2003 |
| WO | WO-03-028757 | 4/2003 |
| WO | WO-03-037060 | 5/2003 |
| WO | WO 2003/059155 A2 | 7/2003 |
| WO | WO-03-106682 | 12/2003 |
| WO | WO-2005-053603 A2 | 6/2005 |
| WO | WO 2005/116074 A2 | 12/2005 |
| WO | WO 2006/064176 A1 | 6/2006 |
| WO | WO 2008/026927 A2 | 3/2008 |

OTHER PUBLICATIONS

Okeefe et al. (The journal of Immunology 2004 Vo. 172 p. 1960).*
Hirschhorn et al. (Genetics in Medicine. vol. 4, No. 2, pp. 45-61, Mar. 2002).*
Ioannidis (Nature Genetics, vol. 29, pp. 306-309, Nov. 2001).*
Ohminami et al. (Blood Jan. 2000 vol. 95 p. 286).*
Tomohiro Kato et al., "Analysis of Accumulated T Cell Clonotypes in Patients With Systemic Lupus Erythematosus," Arthritis & Rhematism, 2000, vol. 43, No. 12, 2712-2721.

(Continued)

*Primary Examiner* — Katherine D Salmon
(74) *Attorney, Agent, or Firm* — Finnegan, Henderson, Farabow, Garrett & Dunner, L.L.P.

(57) ABSTRACT

Disclosed are: a nucleotide sequence and an amino acid sequence for CDR3 region of T-cell receptor (TCR) gene of WT1-specific cytotoxic T-cell (CTL) for WT1 protein; a method for the detection or treatment of cancer using the nucleotide sequence or the amino acid sequence; and a chip, a primer set, a kit, an apparatus and the like for use in the detection of cancer, each of which comprises the nucleotide sequence or the amino acid sequence.

3 Claims, 98 Drawing Sheets

Specification includes a Sequence Listing.

(56) References Cited

OTHER PUBLICATIONS

Christine L. O'Keefe et al., "Molecular Analysis of TCR Clonotypes in LGL: A Clonal Model for Polyclonal Responses[1]," The Journal of Immunology, 2004, vol. 172, No. 3, pp. 1960-1969.
Cinthia Farina et al., "Conserved TCR usage by HLA-Cw*1601-restricted T cell clones recognizing melanoma antigens," International Immunology, 1996, vol. 8, No. 9, pp. 1463-1466.
Yoshihiro Oka et al., "Wilms Tumor Gene Peptide-Based Immunotherapy for Patients with Overt-Leukemia from Myelodysplastic Syndrome (MDS) or MDS with Myelofibrosis," International Journal of Hematology, 2003, vol. 78, No. 1, pp. 56-61.
Yoshiniro Oka et al., "Induction of WT1 (Wilms' tumor gene)—specific cytotoxic T lymphocytes by WT1 peptide vaccine and the resultant cancel regression," Proc. The National Academy of Sciences of the U.S.A., 2004, vol. 101, No. 38, pp. 13885-13890.
Danila Valmori et al, "Vaccination with a Melan-A Peptide Selects an Oligoclonal T Cell Population with Increased Functional Avidity and Tumor Reactivity," The Journal of Immunology, 2002, vol. 168, pp. 4231-4240.
Pierre-Yves Dietrich et al., "Melanoma Patients Respond to a Cytotoxic T Lymphocyte-defined Self-Peptide With Diverse and Nonoverlapping T-Cell Receptor Repertoires[1]," Cancer Research, 2001, vol. 61, pp. 2047-2054.
Pierre G. Coulie et al., "A monoclonal cytolytic T-lymphocyte response observed in a melanoma patient vaccinated with a tumor-specific antigenic peptide encoded by gene MAGE-3," Proc. The National Academy of Sciences of the U.S.A., 2001, vol. 98, No. 18, pp. 10290-10295.
Danièle Godelaine et al, "Polyclonal CTL Responses Observed in Melanoma Patients Vaccinated with Dendritic Cells Pulsed with a MAGE-3 A1 Peptide," The Journal of Immunology, 2003, vol. 171, pp. 4893-4897.
Susanna Mandruzzato et al., "Large and Dissimilar Repertoire of Melan-A/MART-1-Specific CTL in Metastatic Lesions and Blood of a Melanoma Patient," The Journal of Immunology, 2002, vol. 169, pp. 4017-4024.
Office Action dated May 10, 2011 issued in corresponding European application.
Office Action issued in Australian Patent Application No. 2008222061 dated May 31, 2013.
Office Action dated Apr. 16, 2013, issued in Japanese Patent Application No. 2009-502541.
Correspondence dated Nov. 15, 2012, forwarding and describing an Office Action issued in Mexican Patent Application No. MX/a/2009/009589.
Communication pursuant to Article 94(3) EPC dated Oct. 15, 2012, issued in European Patent Application No. 08 720 964.9
Examination Report dated Nov. 27, 2012, issued in Australian Patent Application No. 2008222061.
Xue et al., "Elimination of Human Leukemia Cells NOD/SCID Mice by WT1-TCR Gene-Transduced Human T Cells;" *Blood*, 106, 3062-3067 (2005).
Armstrong et al., "Conformational changes and flexibility in T-cell receptor recognition of peptide-MHC complexes," *Biochem J.*, 415: 183-196 (2008).
Abbey at al., "Expression of T-cell receptor genes during early T-cell development" *Immunology and Cell Biology*, 86:166-174 (2008).
Office Action dated Oct. 23, 2013, issued in Australian Patent Application No. 2008222061.
GenBank accession No. ABF14434.1, T cell receptor beta chain variable region [*Homo sapiens*], submitted Apr. 3, 2006.
GenBank accession No.: BAC01035.1, T cell receptor beta chain [*Homo sapiens*], submitted Dec. 21, 2001.
GenBank accession No. AAP77080.1, AICAR transformylase PurH [*Helicobacter hepaticus* ATCC 51449], submitted May 27, 2003.
GenBank accession No. AF317601.1, *Homo sapiens* T cell receptor beta chain (BV16S1) mRNA, partial CDS, submitted Oct. 29, 2000.
GenBank accession No. CAC06601.1, T-cell receptor beta chain [*Homo sapiens*], submitted Jul. 19, 2000.
GenBank accession No. AAG15764.1, T cell receptor beta chain [*Homo sapiens*], submitted Jul. 31, 2000.
GenBank accession No. AAC52008.1, T cell receptor beta chain, partial [*Homo sapiens*], submitted Jul. 1, 1997.
Office Action dated Dec. 20, 2013, issued in Australian Patent Application No. 2008222061.
Myra Coppage et al., In vitro generation of tumor specific T cells that recognize a shared antigen of AML: Molecular characterization of TCR genes, Leukemia Research, Dec. 6, 2006, vol. 31, No. 2, pp. 195-202, XP-005795007.
J. Zhou et al., "Tumor regression-associated lymphocytes that persist in melanoma patients after adoptive transfer are only minimally present in the original tumors," Database Genbank, Aug. 25, 2003, XP002569162.
Katayoun Rezvani et al., T-Cell Responses Directed against Multiple HLA-A*0201-Restricted Epitopes Derived from Wilms Tumor 1 Protein in Patients with Leukemia and Healthy Donors: Identification, Quantification, and Characterization, Clinical Cancer Research, Dec. 15, 2005, vol. 11, No. 24, pp. 8799-8807, XP-002568654.
Hideki Ohminami et al., "HLA class I-restricted lysis of leukemia cells by a CD8+ cytotoxic T-lymphocyte clone specific for WT1 peptide, "Blood, Jan. 1, 2000, vol. 95, No. 1, pp. 286-293, XP-002190642.
Eva Halapi et al., "T cell receptor usage in malignant diseases, Springer Seminars in Immunopathdogy,", vol. 21, No. 1 pp. 19-35, XP-002568655.
Office Action dated Feb. 4, 2014, issued in Japanese Patent Application No. 2009-502541.
Office Action dated May 6, 2014 issued in European Patent Application No. 08720964.9.
Lefranc et al,. "IMGT unique numbering for immunoglobulin and T cell receptor variable domains and Ig superfamily V-like domains," *Dev. Comp. Immunol.* 27: 55-77 (2003).
English translation of the International Preliminary Report on Patentability with Notification of Transmittal, mailed on Jan. 16, 2014, for International Patent Application No. PCT/JP2012/065707, filed Jun. 20, 2012, by International Institute of Cancer Immunology, Inc. (7 pages).
English translation of the International Search Report, mailed Aug. 7, 2012, for International Patent Application No. PCT/JP2012/065707, filed Jun. 20, 2012, by International Institute of Cancer Immunology, Inc. (2 pages).
Altman, John D., et al., "Phenotypic Analysi of Antigen-Specific T Lymphocytes", *Science*, vol. 274, pp. 94-96, 1996 (3 pages).
Borrello, Ivan M., et al., "Cancer Vaccines for Hematologic Malignancies", *Cancer Control Journal of the Moffitt Cancer Center*, vol. 9, No. 2, Mar./Apr. 2002, pp. 138-151 (14 pages).
Call, Katherine M., et al., "Isolation and Characterization of a Zinc Finger Polypeptide Gene at the Human Chromosome 11 Wilms' Tumor Locus", *Cell*, vol. 60, pp. 509-520, 1990 (12 pages).
Czerkinski, Cecil, et al., "Reverse ELISPOT assay for clonal analysis of cytokine production: I. Enumeration of gamma-interferon-secreting cells", *Journal of Immunological Methods*, vol. 110, pp. 29-36, 1998 (8 pages).
Extended European Search Report issued Jul. 1, 2011 in European Application No. 11154325.2 (11 pages).
Extended European Search Report issued Oct. 31, 2011 in European Application No. 11154327.8 (13 pages).
Extended European Search Report issued Mar. 18, 2015 in European Application No. 14192034.8 (12 pages).
Gessler, Manfred, et al., "Homozygous deletion in Wilms tumours of a zinc-finger gene identified by chromosome jumpking", *Nature*, vol. 343, pp. 774-778, 1990 (5 pages).
Herr, Wolfgang, et al., "Frequency analysis of tumor-reactive cytotoxic T lymphocytes in peripheral blood of a melanoma patient vaccinated with autologous tumor cells", *Cancer Immunology Immunotherapy*, vol. 39, pp. 93-99, 1994 (7 pages).
Kruse, Niels, et al., "Quantificationof cytokine mRNA expression by RT PCR in samples of previously frozen blood", *Journal of Immunological Methods*, vol. 201, pp. 195-203, 1997 (9 pages).

(56) References Cited

OTHER PUBLICATIONS

Lau, Roy, "Phase I Trial of Intravenous Peptide-Pulsed Dendrictic Cells in Patients with Metastatic Melanoma", *Journal of Immunotherapy*, vol. 24, No. 1, pp. 66-78, 2001 (13 pages).

Maeda, Y., et al., "Detection of peptide-specific CTL-precursors in peripheral blood lymphocytes of cancer patients", *British Journal of Cancer*, vol. 87, No. 7, pp. 796-804, 2002 (9 pages).

Menke, A.L., et al., "The Wilms' Tumor 1 Gene: Oncogene or Tumor Suppressor Gene?", *International Review of Cytology*, vol. 181, pp. 151-221, 1998 (32 pages).

Möller, P., et al. "Vaccination with IL-7 gene-modified autologous melanoma cells can enhance the anti-melanoma lytic activity in peripheral blood of patients with a good clinical performance status: a clinical phase I study", *British Journal of Cancer*, vol. 77, No. 11, pp. 1907-1916, 1998 (10 pages).

Nagai, Masahiro, et al., "Increased Activated Human T Cell Lymphotropic Virus Type I (HTLV-I) Tax11-19-Specific Memory and Effector CD8+ Cells in Patients with HTLV-I-Associated Myelopathy/Tropical Spastic Paraparesis: Correlation with HTLV-L Provirus Load", *The Journal of Infectious Diseases*, vol. 183, pp. 197-205, 2001 (9 pages).

Oertil, Daniel, et al. "Rapid Induction of Specific Cytotoxic T Lymphocytes Against Melanoma-Associated Antigens by a Recombinant Vaccinia Virus Vector Expressing Multiple Immunodominant Epitopes and Costimulatory Molecules In Vivo", *Human Gene Therapy*, vol. 13, pp. 569-575, 2002 (7 pages).

Oka, Yoshihiro, et al., "Cancer Immunotherapy Targeting Wilms'Tumor Gene WT1 Product", *Journal of Immunology*, vol. 164, No. 4, pp. 1873-1880, 2000 (8 pages).

Oka, Yoshihiro, et al. "WT1 as a Novel Target Antigen for Cancer Immunotherapy", *Current Cancer Drug Targets*, vol. 2, pp. 45-54, 2002 (10 pages).

Oka, Yoshihiro et al., "Induction of WT1 (Wilms' tumor gene)-specfic cytotoxic T lymphocytes by WT1 peptide vaccine and the resultant cancer regression", *Proceedings of the National Academy of Sciences*, vol. 101, No. 38, Sep. 21, 2004, pp. 13885-13890 (6 pages).

Rezvani, Katayoun, et al. "Functional leukemia-associated antigen-specfic memory CD8+ cells exist in healthy individual and in patients with chronic myelogenous leukemia before and after stem cell transplantation", *Blood*, vol. 102, No. 8, Jun. 26, 2003 (37 pages).

Sugiyama, Haruo, "Wilms'Tumor Gene WT1: Its Oncogenic Function and Clinical Application", *International Journal of Hematology*, vol. 73, pp. 177-187, 2001 (11 pages).

Sugiyama, Haruo, "Cancer Immunotherapy Targeting WT1 Protein", *International Journal of Hematology*, vol. 76, pp. 127-132, 2002 (6 pages).

Tsuboi, Akihiro, "Enhanced induction of human WT1-specific cytotoxic T lymphocytes with a 9-mer WT1 peptide modified at HLA-A*2402-binding residues", *Cancer immunology immunotherapy*, vol. 51, No. 11-12, pp. 614-620, 2002 (7 pages).

Tsuboi, Akihiro, "WT1 Peptide-Based Immunotherapy for Patients with Lung Cancer: Report of Two Cases", *Microbiology and Immunology*, vol. 48, No. 4, pp. 175-184, 2004 (10 pages).

Whiteside, Theresa L., "Monitoring of Antigen-Specific Cytolytic T Lymphocytes in Cancer Patients Receiving Immunotherapy", *Clinical and Diagnostic Laboratory Immunology*, vol. 7, No. 3, pp. 327-332, 2000 (6 pages).

Office Action and Search Report dated Nov. 4, 2014, issued in Chinese Patent Application. No. 201280042412.0 by International Institute of Cancer Immunology, Inc., with English translation (20 pages total).

Partial Supplementary Search Report dated Nov. 27, 2014, issued in European Patent Application No. 12803980.7 by International Institute of Cancer Immunology, Inc. (8 pages).

Partial Supplementary Search Report dated Jan. 5, 2015, issued in European Patent Application No. 12803980.7 by International Institute of Cancer Immunology, Inc. (8 pages).

Ochsenreither, S. et al. (2011) "Wilms Tumor Protein 1' (WT1) Peptide Vaccination-induced Complete Remission in a Patient With Acute Myeloid Leukemia Is Accompanied by the Emergence of a Predominant T-cell Clone Both in Blood and Bone Marrow" *J. Immunother.*, 34(1):85-91.

Ochsenreither, S. et al. (2012) "Wilms' tumor protein 1 (WT1) peptide vaccination in AML patients: predominant TCR CDR3β sequence associated with remission in one patient is detectable in other vaccinated patients" *Cancer Immuncl. Irnmunother*, 61:313-322 (2012).

Genbank Accession No. AAM92197, "T-cell receptor beta chain variable region, partial [*Homo sapiens*]," Published Aug. 10, 2002, (1 page).

Patent Examination Report issued in Australian Patent Application No. 2013206501, dated Jun. 4, 2015 (6 pages).

Patent Examination Report issued in Australian Patent Application No. 2013270605, dated Jun. 4, 2015 (3 pages).

Schumacher, T., "T-Cell-Receptor Gene Therapy," *Nature Reviews Immunology*, vol. 2, Issue 7, Jul. 2002, pp. 512-519 (8 pages).

Willenbrock, K., "Analysis of T-Cell Subpopulations in T-Cell Non-Hodgkin's Lymphoma of Angioimmunoblastic Lymphadenopathy with Dysproteinemia Type by Single Target Gene Amplification of T Cell Receptor-β Gene Rearrangements," *American Journal of Pathology*, vol. 158, No. 5, May 2001, pp. 1851-1857 (7 pages).

Yasukawa, M., *Ketsueki, Shuyou-ka*, vol. 51, No. 3, 2005, pp. 320-326 (11 pages).

European Patent Application No. 12803980.7, filed Jun. 20, 2012, by International Institute of Cancer Immunology, Inc.: Extended European Search Report, including the Supplementary European Search Report and Opinion, dated May 12, 2015.

Office Action mailed May 15, 2015, in U.S. Appl. No. 14/129,695 (19 pages).

Pinilla-Ibarz, J. et al., "Improved human T-cell responses against synthetic HLA-0201 analog peptides derived from the WT1 oncoprotein," *Leukemia*, 20:2025-2033 (2006).

Final Office Action issued in U.S. Appl. No. 14/184,816, dated Aug. 20, 2015 (12 pages).

Kasprowicz, V., "A Highly Restricted T-Cell Receptor Dominates the CD8$_+$T-Cell Response to Parvovirus B19 Infection in HLA-A*2402-Positive Individuals," *Journal of Virology*, Jul. 2006, vol. 80, No. 13 p. 6697-6701 (5 pages).

Eva Halapi et al., "T cell receptor usage in malignant diseases," Springer Seminars in Immunopathology, 1999, vol. 21, No. 1, pp. 19-35, XP-002568655.

U.S. Appl. No. 14/129,695, filed Dec. 27, 2013, by Haruo Sugiyama, entitled "Receptor Gene for Peptide Cancer Antigen-Specific T Cell."

Kruger et al., "Lessons to be learned from primary renal cell carcinomas: novel tumor antigens and HLA ligands for immunotherapy," *Cancer Immunol. Immunother.*, 54: 826-836 (2005).

Robinson et al., "IMGT/HLA Database—a sequence database for the human major histocompatibility complex," *Tissue Antigens*, 55: 280-287 (2000).

U.S. Appl. No. 14/129,695, filed Dec. 27, 2013 by Sugiyama: Final Office Action, dated Jan. 7, 2016, 19 pages.

U.S. Appl. No. 10/562,486, filed Dec. 27, 2005, by Sugiyama: Non-Final Office Action, dated Dec. 2, 2015, with Notice of References Cited (17 pages).

Gotoh, M. et al. (2002) "Development of HLA-A2402/K$^{fi}$ Transgenic Mice" *Int. J. Cancer*, 100:565-570.

U.S. Appl. No. 14/687,628, filed Apr. 15, 2015, by Sugiyama: Office Action, dated Dec. 2, 2016 (21 pages).

Office Action issued in European Patent Application No. 12803980.7 dated Dec. 5, 2016 (5 pages).

Japanese Patent Application No. 2015-151065, filed Jul. 30, 2015, by International Institute of Cancer Immunology Inc: Office Action, dated Jul. 12, 2016 (2 pages), with partial English translation (2 pages).

U.S. Appl. No. 14/184,816, filed Feb. 20, 2014, by Sugiyama: Office Action, dated Nov. 2, 2016 (10 pages).

U.S. Appl. No. 14/687,569, filed Apr. 15, 2015, by Sugiyama: Office Action, dated Aug. 8, 2016 (11 pages).

(56) References Cited

OTHER PUBLICATIONS

Summons to Attend Oral Proceedings pursuant to Rule 115(1) EPC for European Patent Application No. 08720964.9, dated May 2, 2016 (8 pages).
Korean Office Action for Korean Patent Application No. 10-2015-7023123, dated Mar. 24, 2016, with partial English translation (6 pages).
U.S. Appl. No. 14/129,695, filed Dec. 27, 2013, by Sugiyama: Final Office Action, dated Jan. 20, 2017 (14 pages).
U.S. Appl. No. 14/687,569, filed Apr. 15, 2015, by Sugiyama: Office Action, dated Jan. 27, 2017 (13 pages).
Office Action issued in Chinese Patent Application No. 201280042412.0 dated Feb. 9, 2017 (7 pages).
U.S. Appl. No. 14/184,979, filed Feb. 20, 2014, by Sugiyama: Final Office Action, dated Feb. 9, 2017 (15 pages).
Sommer and Tautz, "Minimal homology requirements for PCR primers," *Nucleic Acids Research*, 17(16): 6749 (1989).
Japanese Office Action for Japanese Patent Application No. 2015-151065, dated Jul. 18, 2017, with English translation (5 pages).
U.S. Appl. No. 14/184,816, filed Feb. 20, 2014, by Sugiyama: Final Office Action, dated May 9, 2017 (10 pages).
Office Action dated Mar. 7, 2018, issued by the United States Patent & Trademark Office in U.S. Appl. No. 14/687,569 (6 pages).
Office Action issued in Japanese Patent Application No. 2016-193222 dated Aug. 22, 2017 (13 pages).
U.S. Appl. No. 14/687,628, filed Apr. 15, 2015, by Sugiyama: Non-Final Office Action, dated Aug. 24, 2017 (15 pages).
Office Action issued in Chinese Patent Application No. 201310258589.0 dated Nov. 1, 2017 (19 pages).
Li et al., "The feature of CDR3 sequence of TCR Vβ 21 oligoclonal T cells in CML," Immunological Journal, 16(3): 189-200 (2000).
Toshiro Kurokawa et al.: "Induction and Clonal Expansion of Tumor-Specific Cytotoxic T Lymphocytes from Renal Cell Carcinoma Patients After Stimulation with Autologous Dendritic Cells Loaded with Tumor Cells," *Int. J. Cancer*:91, pp. 749-756 (2001).

E. Hodges et al., "Diagnostic role of test for T cell receptor (TCR) genes," *J. Clin. Pathol.* 56, pp. 1-11 (2003).
Office Action, issued by the Canadian Intellectual Property Office, in corresponding Canadian Patent Application No. 2,679,045, dated Mar. 29, 2018, six (6) pages.
Office Action issued by the Japan Patent Office in corresponding Japan Patent Application No. 2016-193222, dated May 29, 2018, four (4) pages.
Partial English Translation of Office Action issued by the Japan Patent Office in corresponding Japan Patent Application No. 2016-193222, dated May 29, 2018, two (2) pages.
Yutaka Kawakami, "Recent progress in the development of Immunotherapy for melanoma," Skin Cancer, 2004, vol. 19, pp. 25-33.
Non-Final Office Action issued in U.S. Appl. No. 10/562,486, dated Jun. 20, 2018, thirty-five (35) pages.
Brenchley et al., "Expansion of activated human naive T-cells precedes effector function," Clin Exp Immunol, 2002, vol. 130, pp. 431-440.
Pittet et al., "Melan-A/MART-1-specific CD8 T cells: from thymus to tumor," TRENDS in Immunology, vol. 23, No. 7, 2002, pp. 325-328.
Powell et al., "Phenotypic and Functional Maturation of Tumor Antigen-Reactive CD8+ T Lymphocytes in Patients Undergoing Multiple Course Peptide Vaccination," J Immunother, 2004, vol. 27, pp. 36-47.
Lee et al., "Characterization of circulating T cells specific for tumor-associated antigens in melanoma patients," Nature Medicine, 1999, vol. 5, No. 6, pp. 677-85.
Yu et al., "Cancer vaccines: progress reveals new complexities," J Clin Invest. 2002, vol. 110, pp. 289-294.
Meidenbauer et al., "Direct visualization of antigen-specific T cells using peptide-MHC class I tetrameric complexes," Methods, 2003, vol. 31, pp. 160-71.
Andersen et al., "Poor correspondence between predicted and experimental binding of peptides to class I MHC molecules," Tissue Antigens, 2000, vol. 55, pp. 519-531.

\* cited by examiner

Figure 1-1

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 02.01 | TRBV02*01 | TRBJ2-2*01 | TRBD1*01 | 1 | tgtgcc........ | ...ggggc | acccgaata | .aacaccgggagctgttttt | | 1697 | C A G A P R I N T G E L F F |
| 02.02 | TRBV02*01 | TRBJ1-5*01 | | 2 | tgtgcc........ | gggttcgcgcccaacg | | ...agccccagcatttt | | 1698 | C A G F A P N E P Q H F |
| 02.03 | TRBV02*01 | TRBJ1-1*01 | TRBD1*01 | 3 | tgtgcca...... | a ...acag..... | cg | .gaacactgaagcttcttt | | 1699 | C A K Q R N T E A F F |
| 02.04 | TRBV02*01 | TRBJ2-1*01 | TRBD2*01 | 4 | tgtgcc........ | clagagga | .......ggggggg | ...ctacaatgagcagttcttc | | 1700 | C A L E E G G Y N E Q F F |
| 02.05 | TRBV02*01 | TRBJ2-7*01 | TRBD2*01 | 5 | tgtgcca...... | acagtgaagcgcctatc. | .gacta..... | cgac......... | cagtacttc | 1701 | C A N S E A P I D Y D Q Y F |
| 02.06 | TRBV02*01 | TRBJ2-7*01 | TRBD1*01 | 6 | tgtgcca...... | ...acag.... | tgaagcgcctatcga | .ctacgagcagtactc | | 1702 | C A N S E A P I D E Q Y F |
| 02.07 | TRBV02*01 | TRBJ2-3*01 | TRBD2*01 | 7 | tgtgcca...... | acagtatcgactgcgaa | ggggac......... | ...cagatacgcagtatttt | | 1703 | C A N S I D W R K G P D T Q Y F |
| 02.08 | TRBV02*01 | TRBJ1-2*01 | TRBD1*01 | 8 | tgtgcca...... | acgtgttccacga | .....ggggc | ...atggctacacctc | | 1704 | C A N V F H E G H G Y T F |
| 02.09 | TRBV02*01 | TRBJ2-3*01 | TRBD1*01 | 9 | tgtgccagc..... | ..ggaca..... | tt | .acagatacgcagtatttt | | 1705 | C A R D I T D T Q Y F |
| 02.10 | TRBV02*01 | TRBJ2-3*01 | TRBD2*01 | 10 | tgtgccagc..... | gacc...... | cgggg..... | at.....ctatggctacacctc | | 1706 | C A S D P G I Y G Y T F |
| 02.11 | TRBV02*01 | TRBJ2-3*01 | TRBD2*02 | 11 | tgtgccagc..... | ga ...tagcggag... | a | agcacagatacgcagtattt | | 1707 | C A S D S G R S T D T Q Y F |
| 02.12 | TRBV02*01 | TRBJ2-3*01 | TRBD2*02 | 12 | tgtgccagc..... | gggggct | .gactagcgggag... | ccgg......gatacgcagtatttt | | 1708 | C A S G G L T S G S R D T Q Y F |
| 02.13 | TRBV02*01 | TRBJ2-1*01 | TRBD1*01 | 13 | tgtgccagc..... | ggcat ...acagggg... | cg | ...caatgagcagttcttc | | 1709 | C A S G I Q G R N E Q F F |
| 02.14 | TRBV02*01 | TRBJ2-4*01 | TRBD1*01 | 14 | tgtgcagca..... | aggt...gacag..... | aatggtaca | agcaaaacattcagtacttc | | 1710 | C A S K V T E W V Q A K N I Q Y F |
| 02.15 | TRBV02*01 | TRBJ1-5*01 | TRBD1*01 | 15 | tgtgccagca..... | ctgggg ..... | agggggc | gg .......cagccccagcattt | | 1711 | C A S L G R G R Q P Q H F |
| 02.16 | TRBV02*01 | TRBJ1-5*01 | TRBD2*01 | 16 | tgtgcagca..... | atgatgtgtta | ...tagc...... | aatcatcccctg ............attt | | 1712 | C A S N D V V Y S N H P L D F |
| 02.17 | TRBV02*01 | TRBJ2-7*01 | TRBD2*01 | 17 | tgtgcagca..... | atgaagccc... | ctagcg..... | a ...ctacgagcagtactc | | 1713 | C A S N E A P S D Y E Q Y F |
| 02.18 | TRBV02*01 | TRBJ2-7*01 | TRBD2*01 | 18 | tgtgcagca..... | acgaatcc... | actagcg..... | a ...ctacgagcagtactc | | 1714 | C A S N E S T S D Y E Q Y F |
| 02.19 | TRBV02*01 | TRBJ2-7*01 | TRBD1*01 | 19 | tgtgcagca..... | acaggcc | .ggacaca..... | cacgta ...ctacgagcagtactc | | 1715 | C A S N R P D S T Y Y E Q Y F |
| 02.20 | TRBV02*01 | TRBJ2-2*01 | TRBD2*01 | 20 | tgtgcagca..... | ggac | gggact..... | tact ...acaccgggagctgtgtt | | 1716 | C A S R D G T Y Y T G E L F F |
| 02.21 | TRBV02*01 | TRBJ2-2*01 | TRBD1*01 | 21 | tgtgccagcag..... | ggacaggg..... | tg | ...ccggggagctgttttt | | 1717 | C A S R D R G A G E L F F |
| 02.22 | TRBV02*01 | TRBJ2-7*01 | TRBD2*01 | 22 | tgtgccagcag..... | ......ggggc g gac | ...cctacgagcagtactc | | | 1718 | C A S R G G P Y E Q Y F |
| 02.23 | TRBV02*01 | TRBJ2-4*01 | TRBD1*01 | 23 | tgtgccagcag..... | ggt ..gacag..... | aatgggtact | agccaaaaacattcagtacttc | | 1719 | C A S R V T E W V L A K N I Q Y F |
| 02.24 | TRBV02*01 | TRBJ2-5*01 | TRBD2*01 | 24 | tgtgccagcagtg... | cac ..ggacta..... | ccgggggatcaagaa | .....acccagtactc | | 1720 | C A S S A R T T G D Q E T Q Y F |
| 02.25 | TRBV02*01 | TRBJ1-1*01 | TRBD1*01 | 25 | tgtgccagcagtga... | t ..gga..... | Aaggatacgttcatgaacactgaagcttcttt | | | 1721 | C A S S D G K D T F M N T E A F F |
| 02.26 | TRBV02*01 | TRBJ1-1*01 | TRBD1*01 | 26 | tgtgccagcagtga... | tccgcaca gggacag...... | cactgaagcttcttt | | | 1722 | C A S S D P H R D S T E A F F |
| 02.27 | TRBV02*01 | TRBJ1-5*01 | TRBD1*01 | 27 | tgtgccagcagtga... | tgtgggt ta | tagcaatcagccccagcattt | | | 1723 | C A S S D V G Y S N Q P Q H F |
| 02.28 | TRBV02*01 | TRBJ2-7*01 | TRBD2*01 | 28 | tgtgccagcagtgaagc | gc ...ctacgg..... | a | ...ctacgagcagtactc | | 1724 | C A S S E A P S D Y E Q Y F |

Figure 1-2

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 02.29 | TRBV02*01 | TRBJ2-7*01 | TRBD2*01 | 29 | tgtgccagcagtgaagc gc ...ctagc...... aa ..ctacgagcagtactc | | | | | 1725 | C A S S E A P S N Y E Q Y F |
| 02.30 | TRBV02*01 | TRBJ2-3*01 | TRBD2*02 | 30 | tgtgccagcagtgaagc gc ......agcggga... agg ....agatacgcagtatttt | | | | | 1726 | C A S S E A Q R E G D T Q Y F |
| 02.31 | TRBV02*01 | TRBJ2-7*01 | TRBD2*01 | 31 | tgtgccagcagtgaagc ..gactacgg.... a ..ctacgagcagtactc | | | | | 1727 | C A S S E A T S D Y E Q Y F |
| 02.32 | TRBV02*01 | TRBJ1-5*01 | TRBD1*01 | 32 | tgtgccagcagtgaa... ...ggac...... ggcagctcagg ........gcccccagcattt | | | | | 1728 | C A S S E D G S S G P Q H F |
| 02.33 | TRBV02*01 | TRBJ2-5*01 | TRBD2*01 | 33 | tgtgccagcagtgaag..ggg .......gcggggg.. cgcg ....gagaccccagtactc | | | | | 1729 | C A S S E G G G A E T Q Y F |
| 02.34 | TRBV02*01 | TRBJ2-5*01 | TRBD1*01 | 34 | tgtgccagcag...... cgaaggtg ........aggggg ..ccaagagaccagtactc | | | | | 1730 | C A S S E G G G Q E T Q Y F |
| 02.35 | TRBV02*01 | TRBJ2-3*01 | TRBD2*01 | 35 | tgtgccagcagtga... gggactacg...... att ....acagatacgcagtatttt | | | | | 1731 | C A S S E G L A I T D T Q Y F |
| 02.36 | TRBV02*01 | TRBJ2-7*01 | TRBD2*01 | 36 | tgtgccagcagtgaag. ggt ...ctagcgg..... ttt tcctacgagcagtactc | | | | | 1732 | C A S S E G S S G F S Y E Q Y F |
| 02.37 | TRBV02*01 | TRBJ2-7*01 | TRBD2*01 | 37 | tgtgccagcagtgaag. ga ..actacgg...... a tcctacgagcagtactc | | | | | 1733 | C A S S E G T S G S Y E Q Y F |
| 02.38 | TRBV02*01 | TRBJ2-1*01 | TRBD2*02 | 38 | tgtgccagcagtgaa. aacgg ......agcggg... nacatcg......atgagcagttcttc | | | | | 1734 | C A S S E N G A G T S D E Q F F |
| 02.39 | TRBV02*01 | TRBJ2-5*01 | TRBD1*01 | 39 | tgtgccagcagtgaa.. t ...cagg... aacgataatg ....gagaccagtactc | | | | | 1735 | C A S S E S G T I M E T Q Y F |
| 02.40 | TRBV02*01 | TRBJ2-3*01 | TRBD1*01 | 40 | tgtgccagcagtgaa.. ..acagg.... ct ct agcacacagatacgcagtatttt | | | | | 1736 | C A S S E T G S S T D T Q Y F |
| 02.41 | TRBV02*01 | TRBJ2-7*01 | TRBD2*02 | 41 | tgtgccagcagtgaa.. a ......cggga... a .....cctacgagcagtactc | | | | | 1737 | C A S S E T G T Y E Q Y F |
| 02.42 | TRBV02*01 | TRBJ2-5*01 | TRBD2*02 | 42 | tgtgccagcagtg..... gagag ......gcggaggg ggg .....gagaccccagtactc | | | | | 1738 | C A S S G E A G G G E T Q Y F |
| 02.43 | TRBV02*01 | TRBJ2-5*01 | TRBD2*02 | 43 | tgtgccagcagtg..... gaggg ......gcggagg ggggaa......acccagtactc | | | | | 1739 | C A S S G G A G G G E T Q Y F |
| 02.44 | TRBV02*01 | TRBJ2-7*01 | TRBD2*01 | 44 | tgtgccagcag...... cgggggg. aacgagcccatg .............atttt | | | | | 1740 | C A S S G G N E P H D F |
| 02.45 | TRBV02*01 | TRBJ1-5*01 | TRBD1*01 | 45 | tgtgccagcagtg.....ggggag. aacg .....agcccccagcattt | | | | | 1741 | C A S S G G N E P Q H F |
| 02.46 | TRBV02*01 | TRBJ1-5*01 | TRBD1*01 | 46 | tgtgccagcagtg.....ggggg. aaccagcccccatg ................atttt | | | | | 1742 | C A S S G G N Q P H D F |
| 02.47 | TRBV02*01 | TRBJ1-5*01 | TRBD1*01 | 47 | tgtgccagcagtg.....ggggg. aatcagtccatg ..................atttt | | | | | 1743 | C A S S G G N Q S H D F |
| 02.48 | TRBV02*01 | TRBJ2-1*01 | TRBD2*02 | 48 | tgtgccagcag..... cgggacctt ..actacgggag.. ctaggg.......atgagcagttcttc | | | | | 1744 | C A S S G T L L A G A R D E Q F F |
| 02.49 | TRBV02*01 | TRBJ2-1*01 | TRBD2*01 | 49 | tgtgccagcag..... c gggac........ cttactatcccaagctaggg........atgagcagttcttc | | | | | 1745 | C A S S G T L L S Q A R D E Q F F |
| 02.50 | TRBV02*01 | TRBJ2-7*01 | TRBD2*02 | 50 | tgtgccagcagtg..... ggactacgcggggag. cccta tcctacgagcagtactc | | | | | 1746 | C A S S G T S G R P L S Y E Q Y F |
| 02.51 | TRBV02*01 | TRBJ2-7*01 | TRBD1*01 | 51 | tgtgccagcagt...... ttattct .......gggc tccccccg....acgagcagtactc | | | | | 1747 | C A S S L F W A P P D E Q Y F |
| 02.52 | TRBV02*01 | TRBJ2-3*01 | TRBD1*01 | 52 | tgtgccagcag..... cctc..acag... ataccac............tatttt | | | | | 1748 | C A S S L T D T H Y F |
| 02.53 | TRBV02*01 | TRBJ2-3*01 | | 53 | tgtgccagcag..... cct..cacagatacgcagtatttt | | | | | 1749 | C A S S L T D T Q Y F |
| 02.54 | TRBV02*01 | TRBJ2-7*01 | TRBD2*02 | 54 | tgtgccagcagt..... ctggttaa .......cgggag.. agctg...acgagcagtactc | | | | | 1750 | C A S S L V N G R A D E Q Y F |
| 02.55 | TRBV02*01 | TRBJ1-1*01 | TRBD1*01 | 55 | tgtgccagcagt..... at ..gaca..... aggag....cactgaagcttcttt | | | | | 1751 | C A S S M T R S T E A F F |
| 02.56 | TRBV02*01 | TRBJ1-1*01 | TRBD2*01 | 56 | tgtgccagcagt...... aa .......cggggg.. agg .gaacactgaagcttcttt | | | | | 1752 | C A S S N G G N T E A F F |

Figure 1-3

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 02.57 | TRBV02*01 | TRBJ2-3*01 | | 57 | tgtgccagcagt | ccggaaagcctcc | gcacagatacgcagtattt | | | 1753 | C A S S P E S L R T D T Q Y F |
| 02.58 | TRBV02*01 | TRBJ2-7*01 | TRBD2*01 | 58 | tgtgccagcagt | ca | gggact | ggaagcgg | acgagcagtactc | 1754 | C A S S Q G L E A D E Q Y F |
| 02.59 | TRBV02*01 | TRBJ2-1*01 | TRBD2*01 | 59 | tgtgccagcagt | tcc | gggactagc | c | cctacaatgagcagttcttc | 1755 | C A S S S G T S P Y N E Q F F |
| 02.60 | TRBV02*01 | TRBJ2-7*01 | TRBD1*01 | 60 | tgtgccagcagt | tccc | caggg | | tcctacgagcagtactc | 1756 | C A S S S P G S Y E Q Y F |
| 02.61 | TRBV02*01 | TRBJ2-3*01 | TRBD2*02 | 61 | tgtgccagcagt | tcaagt | ggag | | cagatacgcagtattt | 1757 | C A S S S G A D T Q Y F |
| 02.62 | TRBV02*01 | TRBJ2-3*01 | TRBD2*02 | 62 | tgtgccagcag | cact | ctagcggg | t | agcacagatacgcagtattt | 1758 | C A S S T L A G S T D T Q Y F |
| 02.63 | TRBV02*01 | TRBJ1-1*01 | TRBD1*01 | 63 | tgtgccagcagtg | t | acaggg | cct | tgaagcttcttt | 1759 | C A S S V Q G L E A F F |
| 02.64 | TRBV02*01 | TRBJ2-7*01 | TRBD2*01 | 64 | tgtgccagca | ctga | agcg | cctaacga | ctacgagcagtactc | 1760 | C A S T E A P N D Y E Q Y F |
| 02.65 | TRBV02*01 | TRBJ2-3*01 | TRBD2*02 | 65 | tgtgccagca | cgttc | gaggg | agat | acagatacccagtattt | 1761 | C A S T F E G D T D T Q Y F |
| 03.01 | TRBV03-1*01 | TRBJ2-1*01 | TRBD1*01 | 66 | tgtgccagc | | gggc | acctccgt | tcctacaatgagcagttctc | 1762 | C A S G H L R S Y N E Q F F |
| 03.02 | TRBV03-1*01 | TRBJ2-2*01 | TRBD2*01 | 67 | tgtgccagc | cattatagag | ctagcg | t | gaacaccggggagctgttttt | 1763 | C A S H Y R A S V N T G E L F F |
| 03.03 | TRBV03-1*01 | TRBJ1-2*01 | TRBD2*02 | 68 | tgtgccagcagc | | gaggg | tct | ctatgctacacctc | 1764 | C A S S E G L Y G Y T F |
| 03.04 | TRBV03-1*01 | TRBJ2-1*01 | TRBD2*01 | 69 | tgtgccagcagcca | c | ctagcgg | cgag | ctcctacaatgagcagttcttc | 1765 | C A S S H L A A S Y N E Q F F |
| 03.05 | TRBV03-1*01 | TRBJ2-1*01 | TRBD2*02 | 70 | tgtgccagcagcca | tagtatggg | ggggagg | gg | ctacaatgagcagttcttc | 1766 | C A S S H S M G G G G Y N E Q F F |
| 03.06 | TRBV03-1*01 | TRBJ2-1*01 | TRBD2*02 | 71 | tgtgccagcagcca | c | actagcgggaggg | ccgt | aatgagcagttcttc | 1767 | C A S S H T S G R A G N E Q F F |
| 03.07 | TRBV03-1*01 | TRBJ2-3*01 | TRBD2*02 | 72 | tgtgccagcagcc | ttcgatcggt | | ggagg tggg | gatacgcagtattt | 1768 | C A S S L R S G G G G D T Q Y F |
| 03.08 | TRBV03-1*01 | TRBJ1-5*01 | TRBD1*01 | 73 | tgtgccagcagcc | tct | caggg | aaccggtctattcagaccctc | tttt | 1769 | C A S S L S G N R S I Q T P S F |
| 03.09 | TRBV03-1*01 | TRBJ2-7*01 | TRBD2*02 | 74 | tgtgccagcagcc | tat | ctagcggaagg | act | tacgagcagtactc | 1770 | C A S S L S S G R T Y E Q Y F |
| 03.10 | TRBV03-1*01 | TRBJ2-1*01 | TRBD2*01 | 75 | tgtgccagcagcc | ccg cc | gggactag | g | gagcagttcttc | 1771 | C A S S P A G T R E Q F F |
| 03.11 | TRBV03-1*01 | TRBJ2-3*01 | TRBD2*02 | 76 | tgtgccagcagcc | cat | tagcggaa | tt | cacagatacgcagtattt | 1772 | C A S S P L A G F T D T Q Y F |
| 03.12 | TRBV03-1*01 | TRBJ1-6*02 | TRBD2*01 | 77 | tgtgccagcagc | cccga | cggggg | attttt | attcacccctccactt | 1773 | C A S S P P T G D F Y S P L H F |
| 03.13 | TRBV03-1*01 | TRBJ2-1*01 | TRBD2*02 | 78 | tgtgccagcagcc | cacgg | gcgggag | ctggtgg | tgagcagttcttc | 1774 | C A S S P R A G A G G E Q F F |
| 03.14 | TRBV03-1*01 | TRBJ1-4*01 | TRBD1*01 | 79 | tgtgccagcagcc | cacgccccgg | aggg | | gaaaaactgttttt | 1775 | C A S S P R P G G E K L F F |
| 03.15 | TRBV03-1*01 | TRBJ2-3*01 | TRBD2*02 | 80 | tgtgccagcagcc | cc | agcggga | ccttagagcc | tacgcagtattt | 1776 | C A S S P S G T L E A T Q Y F |
| 03.16 | TRBV03-1*01 | TRBJ2-1*01 | TRBD1*01 | 81 | tgtgccagcagcc | ccag | caggggg | g | cctacaatgagcagttctc | 1777 | C A S S P S R G A Y N E Q F F |
| 03.17 | TRBV03-1*01 | TRBJ2-7*01 | TRBD1*01 | 82 | tgtgccagcagcc | ctt | ggaacag | ttcg | tcctacgagcagtactc | 1778 | C A S S P W T G S S Y E Q Y F |
| 03.18 | TRBV03-1*01 | TRBJ2-7*01 | TRBD1*01 | 83 | tgtgccagcagcca | ggc | acaggg | ctcact ctcctacgagcagtactc | TRBJ2-7*01 | 1779 | C A S S Q A Q G G S L S Y E Q Y F |

Figure 1-4

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 03.19 | TRBV03-1*01 | TRBJ1-2*01 | TRBD1*01 | 84 | tgtgccagcagccaaga | cgc | gacaggg | a | atggtacacctc | 1780 | C A S S Q D A T G N G Y T F |
| 03.20 | TRBV03-1*01 | TRBJ1-5*01 | TRBD1*01 | 85 | tgtgccagcagccaaga | cc | ggacaggg | ttggg | aatcagcccagcatttt | 1781 | C A S S Q D R T G V G N Q P Q H F |
| 03.21 | TRBV03-1*01 | TRBJ2-7*01 | TRBD2*01 | 86 | tgtgccagcagccaaga | tagcgg | c | cctacgcagtactc | 1782 | C A S S Q D S G P Y E Q Y F |
| 03.22 | TRBV03-1*01 | TRBJ1-2*01 | | 87 | tgtgccagcagccaaga t | tcaccatct | tatgctcaccttc | | | 1783 | C A S S Q D S P S Y G Y T F |
| 03.23 | TRBV03-1*01 | TRBJ2-1*01 | TRBD1*01 | 88 | tgtgccagcagccaaga | agttcctt | acag | ctcctacaatgagcagttcttc | | 1784 | C A S S Q E G P Y S S Y N E Q F F |
| 03.24 | TRBV03-1*01 | TRBJ1-2*01 | TRBD1*01 | 89 | tgtgccagcagcca | gggg | atgatgctacg | | cctc | 1785 | C A S S Q G M D G Y A F |
| 03.25 | TRBV03-1*01 | TRBJ1-2*01 | TRBD1*01 | 90 | tgtgccagcagccaa | cc | gggacag | cgaaggg | tggctcaccttc | 1786 | C A S S Q P G Q R R G G Y T F |
| 03.26 | TRBV03-1*01 | TRBJ2-1*01 | TRBD2*02 | 91 | tgtgccagcagccaa | cc | gactagcggag | tattt | atgagcagttcttc | 1787 | C A S S Q P T S G S I Y E Q F F |
| 03.27 | TRBV03-1*01 | TRBJ2-7*01 | TRBD2*02 | 92 | tgtgccagcagccaa | caatt | gccggaggg | cg | acgagcagtactc | 1788 | C A S S Q Q L R E G D E Q Y F |
| 03.28 | TRBV03-1*01 | TRBJ2-1*01 | TRBD2*01 | 93 | tgtgccagcagcca | agagta | ggactagc | aac | caatgagcagttcttc | 1789 | C A S S Q R V G L A T N E Q F F |
| 03.29 | TRBV03-1*01 | TRBJ2-7*01 | TRBD2*02 | 94 | tgtgccagcagcca | gtcgg | gccgga | aaa | cctacgagcagtactc | 1790 | C A S S Q S G G K T Y E Q Y F |
| 03.30 | TRBV03-1*01 | TRBJ2-6*01 | TRBD1*01 | 95 | tgtgccagcagccaag | tcatt | gggg | atct ctctgggccaacgtcctgactttc | | 1791 | C A S S Q V I G D L S G A N V L T F |
| 03.31 | TRBV03-1*01 | TRBJ2-1*01 | TRBD2*01 | 96 | tgtgccagcagcc | ggggatt | gactag | | ggaaggcctctccacaatgagcagttcttc | 1792 | C A S S R G L T R E G L S Y N E Q F F |
| 03.32 | TRBV03-1*01 | TRBJ2-6*01 | TRBD2*01 | 97 | tgtgccagcagcc | gacct | gcggg | tgccct | tgggccaacgtcctgactttc | 1793 | C A S S R P A G A L G A N V L T F |
| 03.33 | TRBV03-1*01 | TRBJ1-4*01 | TRBD1*01 | 98 | tgtgccagcagc | gaa | gacag | cag | aatgaaaaactgtttt | 1794 | C A S S R R Q Q N E K L F F |
| 03.34 | TRBV03-1*01 | TRBJ1-2*01 | TRBD1*01 | 99 | tgtgccagcagc | tcccaat | ggac | cgaggaaccgaaggg | ctatgctcaccttc | 1795 | C A S S Q W T E E P K G Y G Y T F |
| 03.35 | TRBV03-1*01 | TRBJ1-1*01 | | 100 | tgtgccagca | cccctcgacga | gaacactgaagcttcttc | | | 1796 | C A S T P S T E N T E A F F |
| 04.001 | TRBV04-2*01 | TRBJ1-3*01 | TRBD1*01 | 101 | tgtgcc | ggcagccaaggatt | ggc cg | tgaaacaccatatttt | | 1797 | C A G S Q G L G R G N T I Y F |
| 04.002 | TRBV04-1*02 | TRBJ2-1*01 | TRBD1*01 | 102 | tgtgccagcag | acaggg | ccc | caatgagcagttcttc | | 1798 | C A S R Q G P N E Q F F |
| 04.003 | TRBV04-1*01 | TRBJ2-2*01 | TRBD1*01 | 103 | tgtgccagcag | aac | gggacaggg | tc | caccgggggagctgttttt | 1799 | C A S R T G Q G S T G E L F F |
| 04.004 | TRBV04-1*01 | TRBJ2-3*01 | TRBD2*01 | 104 | tgtgccagcagc | gat | ggg | t | cgcagtatttt | 1800 | C A S S D G S Q Y F |
| 04.005 | TRBV04-3*01 | TRBJ2-2*01 | TRBD1*01 | 105 | tg | tgccagcagccatcc | cagg | | ccgggggagctgttttt | 1801 | C A S S H P Q A G E L F F |
| 04.006 | TRBV04-1*02 | TRBJ2-1*01 | TRBD2*02 | 106 | tgtgccagcagcca | cccgaggt | tagacggag | acg | acaatgagcagttcttc | 1802 | C A S S H P R L A G D D N E Q F F |
| 04.007 | TRBV04-1*02 | TRBJ2-5*01 | TRBD1*01 | 107 | tgtgccagcagcca | tccga | ggacag | acc | accaagagaccagtactc | 1803 | C A S S H P R T D H Q E T Q Y F |
| 04.008 | TRBV04-1*02 | TRBJ2-7*01 | TRBD2*01 | 108 | tgtgccagcagcca | tccatc | agcgggg | tcggccgg | cgagcagtactc | 1804 | C A S S H P S A G S A G E Q Y F |
| 04.009 | TRBV04-1*01 | TRBJ1-6*01 | TRBD1*01 | 109 | tgtgccagcagca | tagga | gaca | agt | taattcaccctccacttt | 1805 | C A S S H R R Q V N S P L H F |
| 04.010 | TRBV04-1*01 | TRBJ1-3*01 | TRBD2*02 | 110 | tgtgccagcagc | aaag | gggaggg | acggatt | tctgaaacaccatattttt | 1806 | C A S S K G E G R I S G N T I Y F |

Figure 1-5

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 04.011 | TRBV04-3*01 | TRBJ2-2*01 | TRBD1*01 | 111 | tgcgccagcagc... | t ..ggacag..... | aa .cgaacaccgggagctgtttt | | | 1807 | C A S S L D R T N T G E L F F |
| 04.012 | TRBV04-2*01 | TRBJ2-1*01 | TRBD2*01 | 112 | tgtgccagcagcc... | tcggc ..gac.......... | gag .......... | gagcagttcttc | | 1808 | C A S S L G D E E Q F F |
| 04.013 | TRBV04-3*01 | TRBJ2-1*01 | | 113 | tgcgccagcagcc... | taggattgacga ...acaatgagcagttcttc | | | | 1809 | C A S S L G L T N N E Q F F |
| 04.014 | TRBV04-1*02 | TRBJ2-5*01 | TRBD2*02 | 114 | tgcgccagcagcc... | tca ..gactagcgggag.. atgcg .....gagaccagtacttc | | | | 1810 | C A S S L R L A G D A E T Q Y F |
| 04.015 | TRBV04-1*01 | TRBJ2-7*01 | TRBD2*02 | 115 | tgcgccagcagc... | ttgactgtt .......gcgggagg atga... acgagcagtcttc | | | | 1811 | C A S S L T V A G G M N E Q Y F |
| 04.016 | TRBV04-2*01 | TRBJ2-1*01 | TRBD2*01 | 116 | tgtgccagcagcc... | .......tag....... ttggcgaaa .tcctacaatgagcagttcttc | | | | 1812 | C A S S L V A K S Y N E Q F F |
| 04.017 | TRBV04-2*01 | TRBJ1-1*01 | TRBD1*01 | 117 | tgtgccagcagcc... | ttgtccaat ..acag.... tcc ..gaacactgaagcttcttt | | | | 1813 | C A S S L V Q Y S P N T E A F F |
| 04.018 | TRBV04-1*02 | TRBJ1-6*01 | TRBD1*01 | 118 | tgcgccagcagc... | aac ..ggacaggg... acgga ...ataattcaccctccacttt | | | | 1814 | C A S S N G Q G R N N S P L H F |
| 04.019 | TRBV04-1*01 | TRBJ2-2*01 | TRBD2*01 | 119 | tgcgccagcagcc... | cagct gggac....... cct ..gaacaccgggagctgttttt | | | | 1815 | C A S S P A G T L N T G E L F F |
| 04.020 | TRBV04-1*02 | TRBJ1-2*01 | TRBD1*01 | 120 | tgcgccagcagc... | caggggc agc.. aactatgctacacctc | | | | 1816 | C A S S P G G S N Y G Y T F |
| 04.021 | TRBV04-1*01 | TRBJ1-5*01 | TRBD1*01 | 121 | tgcgccagcagcc... | c ..gggacag.... ca tagcaatcagcccagcattt | | | | 1817 | C A S S P G Q H S N Q P Q H F |
| 04.022 | TRBV04-2*01 | TRBJ2-7*01 | TRBD2*01 | 122 | tgtgccagcagcc... | ccttgga .....tagcgg.... agccgggacgaatcaa ........tacttc | | | | 1818 | C A S S P L D S G A G T D Q Y F |
| 04.023 | TRBV04-2*01 | TRBJ2-7*01 | TRBD2*01 | 123 | tgtgccagcagcc... | ccttgga .... tagcgg..... agccgggacg ...... gagcagtactc | | | | 1819 | C A S S P L D S G A G T E Q Y F |
| 04.024 | TRBV04-1*02 | TRBJ2-7*01 | TRBD1*01 | 124 | tgcgccagcagcc... | cactt .....aggg.. tagggc ..cctacgagcagtactc | | | | 1820 | C A S S P L R V G P Y E Q Y F |
| 04.025 | TRBV04-1*02 | TRBJ2-3*01 | TRBD2*02 | 125 | tgcgccagcagcc... | cccc ........ggaggg ..... tacgcagtatttt | | | | 1821 | C A S S P P E G T Q Y F |
| 04.026 | TRBV04-1*01 | TRBJ2-2*01 | TRBD2*02 | 126 | tgcgccagcagcc... | c ........... gagg.. agttt cgaacaccgggagctgtttt | | | | 1822 | C A S S P R S S N T G E L F F |
| 04.027 | TRBV04-1*02 | TRBJ1-2*01 | TRBD2*02 | 127 | tgcgccagcagcc... | cacgtac .......... ggag.. a ctaactatgctacacctc | | | | 1823 | C A S S P R T E T N Y G Y T F |
| 04.028 | TRBV04-3*01 | TRBJ2-5*01 | TRBD2*01 | 128 | tg .......... | tgcagcagcccca ..ggactacgg.... ag ...aagagaccagtacttc | | | | 1824 | C A S S P R T S G E E T Q Y F |
| 04.029 | TRBV04-1*01 | TRBJ2-5*01 | TRBD2*01 | 129 | tgcgccagcagcc... | ......ctacgggggg ccc t .... agagaccagtacttc | | | | 1825 | C A S S P S G G A L E T Q Y F |
| 04.030 | TRBV04-1*01 | TRBJ2-1*01 | TRBD2*02 | 130 | tgcgccagcagcc... | cct c gggacaggg.. agatcgc ........ gttcttc | | | | 1826 | C A S S P S G Q G R S A F F |
| 04.031 | TRBV04-1*01 | TRBJ1-3*01 | TRBD1*01 | 131 | tgcgccagcagcc... | cgagccat ..acaggg... aaca ..ctgaaacaccatatttt | | | | 1827 | C A S S P S H T G N T I Y F |
| 04.032 | TRBV04-1*02 | TRBJ2-1*01 | | 132 | tgcgccagcagcc... | cttcccct ..ctacaatgagcagttcttc | | | | 1828 | C A S S P S L Y N E Q F F |
| 04.033 | TRBV04-1*02 | TRBJ2-7*01 | TRBD2*01 | 133 | tgcgccagcagcc... | cctcc ........cgggg... tcca .tcctacgagcagtacttc | | | | 1829 | C A S S P S R G P S Y E Q Y F |
| 04.034 | TRBV04-1*02 | TRBJ1-3*01 | | 134 | tgcgccagcagcc... | cgtatacg ..ggaaaccacatatttt | | | | 1830 | C A S S P Y T G N T I Y F |
| 04.035 | TRBV04-1*01 | TRBJ1-1*01 | TRBD1*01 | 135 | tgcgccagcagcaag... | catto ....caggg.... atc ..gaacactgaagcttcttt | | | | 1831 | C A S S Q A F Q G S N T E A F F |
| 04.036 | TRBV04-1*02 | TRBJ2-7*01 | TRBD1*01 | 136 | tgcgccagcagccaa gcc ......ggggc cg ..cctacgagcagtacttc | | | | | 1832 | C A S S Q A G A A Y E Q Y F |
| 04.037 | TRBV04-1*01 | TRBJ2-7*01 | TRBD2*02 | 137 | tgcgccagcagcc... | ccagc ..ggactagcgggagg.. a ....tacgagcagtacttc | | | | 1833 | C A S S Q A S G L A G G Y E Q Y F |
| 04.038 | TRBV04-1*01 | TRBJ2-5*01 | TRBD2*02 | 138 | tgcgccagcagcaaga tga ........gaggg taac .....agagaccagtacttc | | | | | 1834 | C A S S Q D E R V T E T Q Y F |

Figure 1-6

| clone # | V name | J name | D name | SEQ ID NO: | V-REGION | N1 | D-REGION | (P) | N2 | J-REGION | SEQ ID NO: | CDR3 amino acid |
|---|---|---|---|---|---|---|---|---|---|---|---|---|
| 04.039 | TRBV04-1*02 | TRBJ2-7*01 | TRBD2*02 | 139 | tgcgccagcagccaa | gattt......cggag... | aac......cgagcagtactc | | | | 1835 | C A S S Q D F G R T E Q Y F |
| 04.040 | TRBV04-3*01 | TRBJ1-2*01 | TRBD1*01 | 140 | tg............... | tgcagcagccaagatgggga....aggggc gc tg...actatgctacacctc | | | | | 1836 | C A S S Q D G E G G A D Y G Y T F |
| 04.041 | TRBV04-2*01 | TRBJ1-1*01 | TRBD1*01 | 141 | tgtgccagcagccaaga | t at c | gggacaggg... | | ccg ...actgaagctttctt | | 1837 | C A S S Q D I G T G P T E A F F |
| 04.042 | TRBV04-1*02 | TRBJ1-3*01 | TRBD1*01 | 142 | tgcgccagcagccaa | gatctg......gggggc ag...tgaaacaccatatattt | | | | | 1838 | C A S S Q D L G G S G N T I Y F |
| 04.043 | TRBV04-3*01 | TRBJ1-1*01 | TRBD1*01 | 143 | tgcgccagcagccaaga | tct a | .......gggc caag | | ...cactgaagcttcttt | | 1839 | C A S S Q D L G P S T E A F F |
| 04.044 | TRBV04-2*01 | TRBJ2-2*01 | TRBD2*02 | 144 | tgcgccagcagccaaga | tcc | ......cggga... tgaag...accgggagctgttttt | | | | 1840 | C A S S Q D P G M E T G E L F F |
| 04.045 | TRBV04-1*01 | TRBJ2-7*01 | TRBD2*01 | 145 | tgcgccagcagccaaga | tc | ......cggg...ctacgagcagtactc | | | | 1841 | C A S S Q D P G Y E Q Y F |
| 04.046 | TRBV04-1*02 | TRBJ1-5*01 | | 146 | tgcgccagcagccaa | gattcagatcagaccac | | | .............cattt | | 1842 | C A S S Q D S D Q T H H F |
| 04.047 | TRBV04-2*01 | TRBJ2-1*01 | TRBD2*02 | 147 | tgtgccagcagccaaga | ......tagcgggag... ctcctacaatgagcagtctc | | | | | 1843 | C A S S Q D S G S S Y N E Q F F |
| 04.048 | TRBV04-3*01 | TRBJ1-5*01 | | 148 | tgcagccagcagccaaga | t | agcggtattgg | | ......tcagcccagcattt | | 1844 | C A S S Q D S G I G Q P Q H F |
| 04.049 | TRBV04-2*01 | TRBJ2-7*01 | TRBD1*01 | 149 | tgcgccagcagccaaga | gatt c gggac... | ...c ctcctacgagcagtactc | | | | 1845 | C A S S Q D S G P S Y E Q Y F |
| 04.050 | TRBV04-1*01 | TRBJ2-2*01 | | 150 | tgcgccagcagcca... | ggattcgc..gcaccgggagctgtttt | | | | | 1846 | C A S S Q D S H T G E L F F |
| 04.051 | TRBV04-1*02 | TRBJ1-5*01 | | 151 | tgcgccagcagccaa | gattca.....aatcagcccagcattt | | | | | 1847 | C A S S Q D S N Q P Q H F |
| 04.052 | TRBV04-1*01 | TRBJ2-7*01 | TRBD1*01 | 152 | tgcgccagcagccaaga | tcccc...actacg... | | | tcc ag ctcctacgagcagtactc | | 1848 | C A S S Q D S P L A S S Y E Q Y F |
| 04.053 | TRBV04-1*01 | TRBJ2-5*01 | | 153 | tgcgccagcagccaaga | cac gt accaagagaccagtactc | | | | | 1849 | C A S S Q D T Y Q E T Q Y F |
| 04.054 | TRBV04-1*01 | TRBJ2-5*01 | TRBD1*01 | 154 | tgtgccagcagccaaga | a | .gacaggg... | | latcc ...gagaccagtactc | | 1850 | C A S S Q E D R V S E T Q Y F |
| 04.055 | TRBV04-1*01 | TRBJ1-5*01 | TRBD1*01 | 155 | tgtgccagcagccaaga | aga ggga... | | | ggtatgat ...caatcagcccagcattt | | 1851 | C A S S Q E E G G M I N Q P Q H F |
| 04.056 | TRBV04-1*01 | TRBJ2-1*01 | TRBD2*01 | 156 | tgcgccagcagccaaga | aittt | ......ggggg... tg | | .......atgagcagttctc | | 1852 | C A S S Q E F G G D E Q F F |
| 04.057 | TRBV04-1*01 | TRBJ2-3*01 | TRBD1*01 | 157 | tgcgccagcagccaaga | agg | ......agcggg... | cit | agcacagatacgcagtattt | | 1853 | C A S S Q E G A G L S T D T Q Y F |
| 04.058 | TRBV04-1*02 | TRBJ1-2*01 | TRBD2*01 | 158 | tgcgccagcagccaaga | agg | ......agggggc ctctc...atggctacacctc | | | | 1854 | C A S S Q E G A S H G Y T F |
| 04.059 | TRBV04-1*01 | TRBJ2-2*01 | TRBD2*01 | 159 | tgtgccagcagccaaga | agggcag...ctagcgg... | | | aggggg.....cggggagctgtttt | | 1855 | C A S S Q E G Q L A E G G G E L F F |
| 04.060 | TRBV04-1*02 | TRBJ2-1*01 | TRBD2*02 | 160 | tgcgccagcagccaaga | gag | .......gggagg g | | ....caatgagcagttctc | | 1856 | C A S S Q E G R G N E Q F F |
| 04.061 | TRBV04-1*01 | TRBJ2-7*01 | TRBD1*01 | 161 | tgcgccagcagccaaga | ac | ...acaggg... atta | | ...tacgagcagtactc | | 1857 | C A S S Q E H R G L Y E Q Y F |
| 04.062 | TRBV04-3*01 | TRBJ2-7*01 | TRBD2*01 | 162 | tgcgccagcagccaaga | aittgggggga gggacta... | | | ag ...tacgagcagtactc | | 1858 | C A S S Q E L G G G T K Y E Q Y F |
| 04.063 | TRBV04-1*02 | TRBJ1-4*01 | TRBD2*01 | 163 | tgcgccagcagccaa | gagcc...cgggggg tcgaaaag | | | ......ctgttttt | | 1859 | C A S S Q E P G G V E K L F F |
| 04.064 | TRBV04-2*01 | TRBJ2-3*01 | TRBD2*02 | 164 | tgcgccagcagccaaga | gca ...agcgggaggg gtgt | | | .......tacgcagtatttt | | 1860 | C A S S Q E Q A G G V V T Q Y F |
| 04.065 | TRBV04-2*01 | TRBJ2-3*01 | TRBD1*01 | 165 | tgtgccagcagccaaga | aaggg ......ggggagg cc gt | | | .....gatacgcagtatttt | | 1861 | C A S S Q E R G E G R D T Q Y F |
| 04.066 | TRBV04-2*01 | TRBJ1-3*01 | TRBD1*01 | 166 | tgtgccagcagccaaga | a | .....agggg. acgaat ctctgaaacaccatatattt | | | | 1862 | C A S S Q E R G R I S G N T I Y F |

Figure 1-7

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 04.067 | TRBV04-2*01 | TRBJ2-7*01 | TRBD2*01 | 167 | tgtgccagcagccaaga | ggtg | gcgggg | tgagg | gagcagtactc | 1863 | C A S S Q E V A G V R E Q Y F |
| 04.068 | TRBV04-1*02 | TRBJ1-3*01 | TRBD2*01 | 168 | tgtgccagcagccaa | gaatggcccgaa | agcgg | to | acaccatatattt | 1864 | C A S S Q E W P E S G H T I Y F |
| 04.069 | TRBV04-1*02 | TRBJ2-7*01 | TRBD2*01 | 169 | tgcgccagcagccaa | cgagc | cgggg | ctacgagcagtactc | | 1865 | C A S S Q G A G G Y E Q Y F |
| 04.070 | TRBV04-1*01 | TRBJ1-6*01 | TRBD1*01 | 170 | tgtgccagcagccaag | gggac | cgaaact | attcaccctccactt | | 1866 | C A S S Q G D R N Y S P L H F |
| 04.071 | TRBV04-1*02 | TRBJ1-1*01 | TRBD1*01 | 171 | tgtgccagcagcagccaa g | gggac | cgctatgt | cactgaagcttctt | | 1867 | C A S S Q G D R Y V V T E A F F |
| 04.072 | TRBV04-1*01 | TRBJ2-7*01 | TRBD1*01 | 172 | tgcgccagcagcagccaag | gggacag | ctcctacgagcagtactc | | | 1868 | C A S S Q G D S S Y E Q Y F |
| 04.073 | TRBV04-2*01 | TRBJ2-7*01 | TRBD2*02 | 173 | tgtgccagcagccaag | ggg | ggaggg g | tacgagcagtactc | | 1869 | C A S S Q G G E G Y E Q Y F |
| 04.074 | TRBV04-1*02 | TRBJ2-7*01 | TRBD2*01 | 174 | tgcgccagcagccaag | g | gcggggggg aaa | cctacgagcagtactc | | 1870 | C A S S Q G G G G E T Y E Q Y F |
| 04.075 | TRBV04-2*01 | TRBJ1-1*01 | TRBD1*01 | 175 | tgtgccagcagccaag | gcgg gggacagg | ttttat | cactgaagcttctt | | 1871 | C A S S Q G G G Q G F I T E A F F |
| 04.076 | TRBV04-3*01 | TRBJ2-2*01 | TRBD1*01 | 176 | tg | tgccagcagcca | agggg to | ccggggagctgttttt | | 1872 | C A S S Q G G P G E L F F |
| 04.077 | TRBV04-1*02 | TRBJ2-5*01 | TRBD2*01 | 177 | tgtgccagcagccaa | ggggg ac | ccaagagaccagtactc | | | 1873 | C A S S Q G G T Q E T Q Y F |
| 04.078 | TRBV04-2*01 | TRBJ2-3*01 | TRBD2*02 | 178 | tgtgccagcagccaag | gactagcgggaggg cc agg | tacgcagtatttt | | | 1874 | C A S S Q G L A G G P G T Q Y F |
| 04.079 | TRBV04-2*01 | TRBJ2-1*01 | TRBD2*02 | 179 | tgtgccagcagccaa | ggat | gaggg c tagttgggttttg | acaatgagcagtcttc | | 1875 | C A S S Q G M R A S W G F D N E Q F F |
| 04.080 | TRBV04-1*01 | TRBJ1-5*01 | TRBD1*01 | 180 | tgcgccagcagccaag | gacgg ta tagcaatcagcccagcatttt | | | | 1876 | C A S S Q G R Y S N Q P Q H F |
| 04.081 | TRBV04-1*02 | TRBJ2-3*01 | TRBD2*01 | 181 | tgtgccagcagccaa | ggggtcgg | gcggg | ctaactatgctacaccttc | | 1877 | C A S S Q G V G R A N Y G Y T F |
| 04.082 | TRBV04-2*01 | TRBJ2-3*01 | TRBD2*02 | 182 | tgtgccagcagccaa | aa | actagccggga at | acagatacgcagtatttt | | 1878 | C A S S Q K L A G D T D T Q Y F |
| 04.083 | TRBV04-2*01 | TRBJ2-1*01 | TRBD2*02 | 183 | tgtgccagcagcca | aaa cc gggactagcggga | ttca | acagagcagtactc | | 1879 | C A S S Q K P G L A G F N E Q Y F |
| 04.084 | TRBV04-1*02 | TRBJ1-5*01 | TRBD1*01 | 184 | tgtgccagcagccaa | aaat | gggg taatcac | ccccagcatttt | | 1880 | C A S S Q K W G N H P Q H F |
| 04.085 | TRBV04-3*01 | TRBJ2-3*01 | TRBD1*01 | 185 | tgtgccagcagccaa | aagt | acaggg | ttctggaactcg gcacagatacgcagtattt | | 1881 | C A S S Q K Y R V L E L G T D T Q Y F |
| 04.086 | TRBV04-1*01 | TRBJ2-3*01 | TRBD2*02 | 186 | tgtgccagcagccaa | ctto | gcgggagg gtag | cagatacgcagtactt | | 1882 | C A S S Q L A G G V A D T Q Y F |
| 04.087 | TRBV04-1*01 | TRBJ2-5*01 | TRBD1*01 | 187 | tgcgccagcagccaa | ct c gggacagggggc gc gggg | gagaccagtactc | | | 1883 | C A S S Q L G T G G A G E T Q Y F |
| 04.088 | TRBV04-1*02 | TRBJ2-7*01 | TRBD2*02 | 188 | tgcgccagcagcca | gcc gggactagcgga | tatg | atgagcagtactc | | 1884 | C A S S Q P G L A G Y D E Q F F |
| 04.089 | TRBV04-1*02 | TRBJ2-5*01 | TRBD1*01 | 189 | tgcgccagcagcca | gcctct gggacag | a | aagagaccagtactc | | 1885 | C A S S Q P L G Q K E T Q Y F |
| 04.090 | TRBV04-1*01 | TRBJ1-2*01 | TRBD1*01 | 190 | tgcgccagcagcca | a | ggc g gttggg | actatgctacacctc | | 1886 | C A S S Q R A V G D Y G Y T F |
| 04.091 | TRBV04-1*02 | TRBJ2-1*01 | TRBD2*02 | 191 | tgcgccagcagccaa cg c gggactagcggga | ag | aatgagcagttcttc | | | 1887 | C A S S Q R G T S G K N E Q F F |
| 04.092 | TRBV04-1*02 | TRBJ2-7*01 | TRBD1*01 | 192 | tgtgccagcagcca | c | gaca | aactgg | ctacgagcagtactc | 1888 | C A S S Q R Q T G Y E Q Y F |
| 04.093 | TRBV04-3*01 | TRBJ1-1*01 | TRBD2*01 | 193 | tgcgccagcagccaa | tcgt | tagc | tgtagctac ctcctacaatgagcagttcttc | | 1889 | C A S S Q S L A V A T S Y N E Q F F |
| 04.094 | TRBV04-1*01 | TRBJ2-7*01 | TRBD2*02 | 194 | tgtgccagcagcca | gac | ccggaggg ggcc ctcctacgagcagtactc | | | 1890 | C A S S Q T G R G P S Y E Q Y F |

Figure 1-8

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 04.095 | TRBV04-1*02 | TRBJ2-7*01 | TRBD2*01 | 195 | tgcgccagcagccaa | a cc gggact | | tcctacgagcagttc | | 1891 | C A S S Q T G T S Y E Q Y F |
| 04.096 | TRBV04-1*01 | TRBJ2-7*01 | TRBD2*01 | 196 | tgggccagcagccaag | tgcga | agcggggg | ag | cctacgagcagtacttc | 1892 | C A S S Q V R S G G A Y E Q Y F |
| 04.097 | TRBV04-1*02 | TRBJ1-2*01 | | 197 | tgcgccagcagccaa | gtatcaga | ag | ctaactatgctacacctc | | 1893 | C A S S Q V S E A N Y G Y T F |
| 04.098 | TRBV04-1*02 | TRBJ1-2*01 | TRBD1*01 | 198 | tgcgccagcagccaa | gt | gacaggggc | tc | ctatgctacacctc | 1894 | C A S S Q V T G G S Y G Y T F |
| 04.099 | TRBV04-1*02 | TRBJ2-7*01 | TRBD1*01 | 199 | tgcgccagcagcca | gtgtaacg | gggacaggg | cga | tacgagcagttc | 1895 | C A S S Q V T G T G R Y E Q Y F |
| 04.100 | TRBV04-1*01 | TRBJ2-7*01 | | 200 | tgcgccagcagccaag | ttaca | tcctacgagcagttc | | | 1896 | C A S S Q V T S Y E Q Y F |
| 04.101 | TRBV04-1*02 | TRBJ2-1*01 | TRBD2*02 | 201 | tgcgccagcagcc | g | gggactagcgggagg | ac | acaatgagcagttctc | 1897 | C A S S R G L A G G H N E Q F F |
| 04.102 | TRBV04-1*01 | TRBJ2-1*01 | TRBD2*02 | 202 | tgcgccagcagc | | tcagac | actacgggag | caccagggg | caatgagcagttcttc | 1898 | C A S S D T S G S T R G N E Q F F |
| 04.103 | TRBV04-1*01 | TRBJ2-5*01 | TRBD1*01 | 203 | tgcgccagcag | | ttc | caggggg | tgga | agaccagtacttc | 1899 | C A S S R G W K T Q Y F |
| 04.104 | TRBV04-2*01 | TRBJ2-1*01 | | 204 | tgtgccagcagc | | acatcgtctgcg | acaatgagcagttcttc | | 1900 | C A S S T S S R D N E Q F F |
| 04.105 | TRBV04-2*01 | TRBJ1-4*01 | TRBD1*01 | 205 | tgccagcagc | | tac | gacaggg | ag | actaatgaaaaactgttttt | 1901 | C A S S Y D R E T N E K L F F |
| 04.106 | TRBV04-1*01 | TRBJ2-7*01 | TRBD1*01 | 206 | tgcgccagcagc | | tactac | caggggg | gcgg | cgagcagtacttc | 1902 | C A S S Y Y Q G G G E Q Y F |
| 05.001 | TRBV05-6*01 | TRBJ2-1*01 | TRBD2*01 | 207 | tgtgcc | | tgcagcttgggaa | | cgggg | ctacaatgg | gcagttcttc | 1903 | C A C S F G E R G Y N G Q F F |
| 05.002 | TRBV05-6*01 | TRBJ2-6*01 | TRBD2*01 | 208 | tgtgcca | | accgccgatcgtggg | agcgg | ttgtg | tctggggccaacgtcctgacttc | 1904 | C A N P P I V G A V V S G A N V L T F |
| 05.003 | TRBV05-6*01 | TRBJ2-1*01 | TRBD1*01 | 209 | tgtgcca | | acagcttg gggac | cgggcoaacaatgaa | cagttcttc | | 1905 | C A N S F G D R A N N E Q F F |
| 05.004 | TRBV05-6*01 | TRBJ2-1*01 | TRBD1*01 | 210 | tgtgcc | | cccagcttg gggacaggg | cctacagtgaca | agttcttc | | 1906 | C A P S F G D R A Y S D K F F |
| 05.005 | TRBV05-8*01 | TRBJ2-1*01 | TRBD1*01 | 211 | tgtgccag | | agaaggg | caggg | c | cctacaatgagcagttcttc | 1907 | C A R E G Q G P Y N E Q F F |
| 05.006 | TRBV05-4*01 | TRBJ2-7*01 | | 212 | tgtgcc | | cgcagcttgcctccggctatgaacaa | | ttcttc | | 1908 | C A R S F A S G Y E Q F F |
| 05.007 | TRBV05-6*01 | TRBJ2-1*01 | TRBD2*02 | 213 | tgtgccag | | tgaa | ggaggg ccc g | | atgagcagttcttc | 1909 | C A S E G G P D E Q F F |
| 05.008 | TRBV05-4*01 | TRBJ2-3*01 | TRBD2*01 | 214 | tgtgccagc | | gggac | actagcg | acc agcacagatacgcagtatttt | | 1910 | C A S G T L A T S T D T Q Y F |
| 05.009 | TRBV05-1*01 | TRBJ1-1*01 | TRBD1*01 | 215 | tgcgccagc | | caccaagcg | gggggc | t | acactgaagcttcttt | 1911 | C A S H Q A G G Y T E A F F |
| 05.010 | TRBV05-1*01 | TRBJ2-5*01 | TRBD2*01 | 216 | tgcgccagca | a | actacgggggg | aac | ccaagagaccagtacttc | | 1912 | C A S K L A G G T Q E T Q Y F |
| 05.011 | TRBV05-1*01 | TRBJ1-1*01 | | 217 | tgcgccagca | | tggt ggga | g | acactgaagcttcttt | | 1913 | C A S M V G D T E A F F |
| 05.012 | TRBV05-5*01 | TRBJ2-1*01 | TRBD1*01 | 218 | tgcgccagca | acctt | ggc ctcaacc | cctacaatgagcagttcttc | | | 1914 | C A S N L G L N P Y N E Q F F |
| 05.013 | TRBV05-6*01 | TRBJ1-1*01 | TRBD1*01 | 219 | tgccagc | cctttg | gggacagg | ccctacc | atgagcagttcttc | | 1915 | C A S P F G D R P Y H E Q F F |
| 05.014 | TRBV05-4*01 | TRBJ2-1*01 | TRBD1*01 | 220 | tgtgccagcag | ggatg | aggg | ttgtgg | aatgagcagttcttc | | 1916 | C A S R D E G L W N E Q F F |
| 05.015 | TRBV05-1*01 | TRBJ2-1*01 | TRBD1*01 | 221 | tgcgccagc | | agggg | gaa tcctacaatgagcagttcttc | | | 1917 | C A S R G E S Y N E Q F F |

Figure 1-9

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 05.016 | TRBV05-4*01 | TRBJ2-7*01 | TRBD1*01 | 222 | tgtgccagcag | gatc | caggg | | ctacgagcagttcttc | 1918 | C A S R I Q G Y E Q Y F |
| 05.017 | TRBV05-1*01 | TRBJ2-1*01 | TRBD2*01 | 223 | tgcgcagcag | att | ggg | tgagagctcctacaatgagcagttcttc | | 1919 | C A S R L G E S S Y N E Q F F |
| 05.018 | TRBV05-6*01 | TRBJ2-1*01 | TRBD2*01 | 224 | tgtgccagcag | gcta | c gggact | tta | cctacaatgagcagttcttc | 1920 | C A S R L R D F T Y N E Q F F |
| 05.019 | TRBV05-8*01 | TRBJ2-1*01 | TRBD2*01 | 225 | tgtgccagcag | accc | ctagc | agagat | ctacaatgagcagttcttc | 1921 | C A S R P L A E I Y N E Q F F |
| 05.020 | TRBV05-5*03 | TRBJ2-3*01 | TRBD1*01 | 226 | tgtgccagcag | gcccctc | gacag | | acagatacgcagtattt | 1922 | C A S R P P P R Q T D T Q Y F |
| 05.021 | TRBV05-1*01 | TRBJ2-1*0 | TRBD2*01 | 227 | tgccgccagcag | acaa | gggacta | ct | aatgagcagttcttc | 1923 | C A S R Q G T T N E Q F F |
| 05.022 | TRBV05-1*01 | TRBJ2-3*01 | TRBD2*02 | 228 | tgcgcagcag | acg | gggga | cga | cacagatacgcagtatttt | 1924 | C A S R R R D D T D T Q Y F |
| 05.023 | TRBV05-6*01 | TRBJ2-7*01 | TRBD2*02 | 229 | tgtgccagcagc | gccgggggtt | tagcgggag | agggct | cgagcagtacttc | 1925 | C A S S A G G F S G R G L E Q Y F |
| 05.024 | TRBV05-1*01 | TRBJ2-3*01 | TRBD2*02 | 230 | tgccgccagcagc | gcctc | agcgggag | ttgaag | cagatacgcagtatttt | 1926 | C A S S A G V E A D T Q Y F |
| 05.025 | TRBV05-1*01 | TRBJ2-1*01 | TRBD1*01 | 231 | tgcgccagcagc | gcgt | caggggg | ctacaatgagcagttct | | 1927 | C A S S A G G Y N E Q F F |
| 05.026 | TRBV05-4*01 | TRBJ2-1*01 | TRBD2*02 | 232 | tgtgccagcagc | gaaaattcccct | ctagccggagg | taga | aatgagcagttcttc | 1928 | C A S S E N S P L A G G R N E Q F F |
| 05.027 | TRBV05-4*01 | TRBJ2-7*01 | TRBD2*01 | 233 | tgtgccagcagctt | c | gcggg | ctcc ag ctcctacgagcagtacttc | | 1929 | C A S S F A G S S Y E Q Y F |
| 05.028 | TRBV05-6*01 | TRBJ2-1*01 | TRBD1*01 | 234 | tgtgccagcagctt | t | gaca | aaaa ctcctacgcagttcttc | | 1930 | C A S S F D K N S Y E Q Y F |
| 05.029 | TRBV05-8*01 | TRBJ2-1*01 | TRBD2*02 | 235 | tgtgccagcagctt | tga | agcgggagg | ctcctacaatgagcagttcttc | | 1931 | C A S S F E A G G S Y N E Q F F |
| 05.030 | TRBV05-1*01 | TRBJ2-1*01 | TRBD1*01 | 236 | tgcgccagcagctt | ttt | caatgagcagttcttc | | | 1932 | C A S S F F N E Q F F |
| 05.031 | TRBV05-8*01 | TRBJ2-7*01 | TRBD2*01 | 237 | tgtgccagcagctt | tgggg | ctaggg | ctacgagcagtactc | | 1933 | C A S S F G A S G G Y E Q Y F |
| 05.032 | TRBV05-4*01 | TRBJ2-7*01 | TRBD2*01 | 238 | tgtgccagcagctt | cg gggaca | tcg g ctcctacgagcagtacttc | | | 1934 | C A S S F G D I G S Y E Q Y F |
| 05.033 | TRBV05-6*01 | TRBJ2-1*01 | TRBD1*01 | 239 | tgtgccagcagctt | tg gggacaggg | cca | acaatgagcagttcttc | | 1935 | C A S S F G D R A N N E Q F F |
| 05.034 | TRBV05-6*01 | TRBJ2-1*01 | TRBD1*01 | 240 | tgtgccagcagctt | tg gggacaggg | cctacaatgagcagttcttc | | | 1936 | C A S S F G D R A Y N E Q F F |
| 05.035 | TRBV05-6*01 | TRBJ2-1*01 | TRBD1*01 | 241 | tgtgccagcagctt | tg gggacaggg | cctact | atgagcagttcttc | | 1937 | C A S S F G D R A Y Y E Q F F |
| 05.036 | TRBV05-6*01 | TRBJ2-1*01 | TRBD1*01 | 242 | tgtgccagcagctt | tg gggacaggg | a | ctacaatgagcagttcttc | | 1938 | C A S S F G D R D Y N E Q F F |
| 05.037 | TRBV05-6*01 | TRBJ2-1*01 | TRBD1*01 | 243 | tgtgccagcagctt | t | ggggc agggcctacaatgagcagtc | cttc | | 1939 | C A S S F G G R A Y N E Q S F |
| 05.038 | TRBV05-1*02 | TRBJ1-2*01 | TRBD1*01 | 244 | tgccgccagc | agctt c gggacag | cgaccgaagg | ctatgctacacctc | | 1940 | C A S S F G T A T E G Y G Y T F |
| 05.039 | TRBV05-4*01 | TRBJ1-1*01 | TRBD1*01 | 245 | tgtgccagcagctt | t gggac | ggaaa | aagcttcttt | | 1941 | C A S S F G T E K A F F |
| 05.040 | TRBV05-5*03 | TRBJ2-7*01 | TRBD1*01 | 246 | tgtgccagcagc tt | c gggacagggg | cccttggg | gagcagtacttc | | 1942 | C A S S F G T G A L G E Q Y F |
| 05.041 | TRBV05-1*01 | TRBJ2-1*01 | TRBD2*01 | 247 | tgccgccagcagc | c | ctagccgg | ttta | tacaatgagcagttcttc | 1943 | C A S S F L A G L Y N E Q F F |
| 05.042 | TRBV05-4*01 | TRBJ2-1*01 | TRBD2*01 | 248 | tgtgccagcagctt | tct gggacta | aga | tacaatgagcagttcttc | | 1944 | C A S S F L G L R Y N E Q F F |
| 05.043 | TRBV05-6*01 | TRBJ2-5*01 | TRBD2*01 | 249 | tgtgccagcagctt | tttgggc | agcggg | gagaccagtacttc | | 1945 | C A S S F L G S G E T Q Y F |

Figure 1-10

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 05.044 | TRBV05-1*01 | TRBJ1-3*01 |  | 250 | tgtgccagcagctt.. | taa | ctctggaaacaccatatattt |  |  | 1946 | C A S S F N S G N T I Y F |
| 05.045 | TRBV05-4*01 | TRBJ2-7*01 | TRBD2*01 | 251 | tgtgccagcagctt.. | ccca ..ggact........ | ta | ....acgagcagtactc |  | 1947 | C A S S F P G L N E Q Y F |
| 05.046 | TRBV05-4*01 | TRBJ2-7*01 | TRBD1*01 | 252 | tgtgccagcagctt.. | c ccc gggacaggggc c | ......acgagcagtactc |  |  | 1948 | C A S S F P G T G G H E Q Y F |
| 05.047 | TRBV05-6*01 | TRBJ2-7*01 |  | 253 | tgtgccagcagctt.. | tccgaaccacct gag ctcctacgagcagtactc |  |  |  | 1949 | C A S S F P N H L S S Y E Q Y F |
| 05.048 | TRBV05-1*01 | TRBJ2-1*01 | TRBD1*01 | 254 | tgtgccagcagctt.. | tccc ...acagggggc aggg | ........atgaacagttcttc |  |  | 1950 | C A S S F P T G G R D E Q F F |
| 05.049 | TRBV05-5*01 | TRBJ2-5*01 | TRBD2*01 | 255 | tgtgccagcagctt.. | cc gggac............ | ggaac ..ccaagagaccagtactc |  |  | 1951 | C A S S F R D G T Q E T Q Y F |
| 05.050 | TRBV05-6*01 | TRBJ2-5*01 | TRBD1*01 | 256 | tgtgccagcagctt.. | cc gggacag..... | accga ..aagagaccagtactc |  |  | 1952 | C A S S F R D R P K E T Q Y F |
| 05.051 | TRBV05-1*01 | TRBJ2-7*01 | TRBD1*01 | 257 | tgtgccagcagctt.. | cc gggacag... | a ag ctcctacgagcagtactc |  |  | 1953 | C A S S F R D R S S Y E Q Y F |
| 05.052 | TRBV05-1*01 | TRBJ2-1*01 | TRBD1*01 | 258 | tgtgccagcagctt.. | cc gggaca........ | ...cctacaatgagcagttcttc |  |  | 1954 | C A S S F R D T Y N E Q F F |
| 05.053 | TRBV05-5*01 | TRBJ1-5*01 | TRBD2*01 | 259 | tgtgccagcagctt.. | .....caggggg tcgg | ...gcaatcagcccagcattt |  |  | 1955 | C A S S F R G S G N Q P Q H F |
| 05.054 | TRBV05-1*01 | TRBJ2-1*01 | TRBD1*01 | 260 | tgtgccagcagctt.. | cc ..gacta........ | .tcctacaatgagcagttcttc |  |  | 1956 | C A S S F R L S Y N E Q F F |
| 05.055 | TRBV05-4*01 | TRBJ2-1*01 | TRBD2*01 | 261 | tgtgccagcagctt.. | .......tagcgggg.... | ...cctacaatgagcagttcttc |  |  | 1957 | C A S S F S G A Y N E Q F F |
| 05.056 | TRBV05-1*01 | TRBJ1-1*01 | TRBD2*01 | 262 | tgtgccagcagctt.. | ......tagcgggg....... | .....tagcgggg........ cctacaatgagcg........... |  | gttcttc | 1958 | C A S S F S G A Y N E R F F |
| 05.057 | TRBV05-1*01 | TRBJ2-1*01 | TRBD1*01 | 263 | tgtgccagcagctt.. | ctca gggac....... | gtccgattt ...tacaatgagcagttcttc |  |  | 1959 | C A S S F S G T S D F Y N E Q F F |
| 05.058 | TRBV05-6*01 | TRBJ1-1*01 |  | 264 | tgtgccagcagctt.. | tagt ..aacactgaagctcttt |  |  |  | 1960 | C A S S F S N T E A F F |
| 05.059 | TRBV05-6*01 | TRBJ2-6*01 | TRBD1*01 | 265 | tgtgccagcagctt.. | ttcgcctgg gggacag..... | cctct ctctgggccaacgtcctgactc |  |  | 1961 | C A S S F S P G G Q P L S G A N V L T F |
| 05.060 | TRBV05-1*01 | TRBJ1-4*01 | TRBD1*01 | 266 | tgtgccagcagctt.. | c ..acaggggc g atgcg | ......gaaaaactgttt |  |  | 1962 | C A S S F T G G D A E K L F F |
| 05.061 | TRBV05-1*02 | TRBJ2-1*01 | TRBD1*01 | 267 | tgtgccagc....... | agcttgt ......gggg. aagc ..cctacaatgagcagttcttc |  |  |  | 1963 | C A S S F V G K P Y N E Q F F |
| 05.062 | TRBV05-4*01 | TRBJ2-7*01 | TRBD1*01 | 268 | tgtgccagcagc.. | gg gggacaggg. accgt ...ctacgagcagtactc |  |  |  | 1964 | C A S S G G Q G T V Y E Q Y F |
| 05.063 | TRBV05-4*01 | TRBJ1-1*01 | TRBD1*01 | 269 | tgtgccagcagc... | .........ggggc cgcactgaat........ | ctttt |  |  | 1965 | C A S S G G R T E S F F |
| 05.064 | TRBV05-1*01 | TRBJ2-7*01 | TRBD2*01 | 270 | tgtgccagcagc... | ..........ggggg ctcctacgagcagtactc |  |  |  | 1966 | C A S S G G S Y E Q Y F |
| 05.065 | TRBV05-1*01 | TRBJ2-3*01 | TRBD2*01 | 271 | tgtgccagcagc.. | gga ..actacgcggag.... | ....agatacgcagtattt |  |  | 1967 | C A S S G T S G R D T Q Y F |
| 05.066 | TRBV05-1*01 | TRBJ2-5*01 | TRBD1*01 | 272 | tgtgccagcagc.. | cacgggtccgac ..ggac..... | ca ..caagagaccagtactc |  |  | 1968 | C A S S H G S D G P Q E T Q Y F |
| 05.067 | TRBV05-1*01 | TRBJ1-2*01 | TRBD1*01 | 273 | tgtgccagcagc.. | cac gggacaggg.... | agcgg | ....tggctacacctc |  | 1969 | C A S S H G T G S G G Y T F |
| 05.068 | TRBV05-1*01 | TRBJ2-5*01 | TRBD2*02 | 274 | tgtgccagcag..... | tatcgggga..... tagcggga.... to ..gagaccagtactc |  |  |  | 1970 | C A S S I G G S G I E T Q Y F |
| 05.069 | TRBV05-4*01 | TRBJ2-5*01 | TRBD2*01 | 275 | tgtgccagcagcttgg..... | cgggggg gag ....gagaccagtactc |  |  |  | 1971 | C A S S L A G G E E T Q Y F |
| 05.070 | TRBV05-1*01 | TRBJ2-1*01 | TRBD2*01 | 276 | tgtgccagcagcttgg | ccg ......gcgg.... | a ..tacaatgagcagttcttc |  |  | 1972 | C A S S L A G G Y N E Q F F |
| 05.071 | TRBV05-1*01 | TRBJ1-1*01 | TRBD1*01 | 277 | tgtgccagcagcttgg | ...caggggc t ..acactgaagctcttt |  |  |  | 1973 | C A S S L A G G Y T E A F F |

Figure 1-11

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 05.072 | TRBV05-1*01 | TRBJ2-1*01 | TRBD2*02 | 278 | tgcgccagcagcttgg | ca | ggaggg tacgt | | tgagcagttcttc | 1974 | C A S S L A G G Y V E Q F F |
| 05.073 | TRBV05-6*01 | TRBJ2-2*01 | TRBD1*01 | 279 | tgtgccagcagctt. | ag | ...cagg... ttgatt | ..aacaccgggagctgttttt | | 1975 | C A S S L A G L I N T G E L F F |
| 05.074 | TRBV05-1*01 | TRBJ1-2*01 | TRBD1*01 | 280 | tgcgccagcagcttgg | ...cagg... | cagtg | ...actatgctacacccttc | | 1976 | C A S S L A G S D Y G Y T F |
| 05.075 | TRBV05-4*01 | TRBJ2-5*01 | TRBD2*02 | 281 | tgtgccagcagcttgg | ccat | gagg. t | accaagagaccccagtactc | | 1977 | C A S S L A M R Y Q E T Q Y F |
| 05.076 | TRBV05-4*01 | TRBJ2-7*01 | | 282 | tgcgccagcagctgg cc ccag | ..cctacgagcagtactc | | | | 1978 | C A S S L A P A Y E Q Y F |
| 05.077 | TRBV05-4*01 | TRBJ2-1*01 | TRBD2*02 | 283 | tgtgccagcagcttgg | ccc | ...cgggag... tgggg | ....aatgagcagttcttc | | 1979 | C A S S L A P G V G N E Q F F |
| 05.078 | TRBV05-1*02 | TRBJ2-1*01 | TRBD2*01 | 284 | tgcgccagc..... | agcttgcgagaggat ..ggactagcggg... cttttccttctcta.....aatgagcagttcttc | | | | 1980 | C A S S L A R G W T S G L F P S L N E Q F F |
| 05.079 | TRBV05-6*01 | TRBJ2-5*01 | TRBD2*01 | 285 | tgtgccagcagctt. | ag | ...ctagcgggg..... | aagagaccccagtactc | | 1981 | C A S S L A S G E E T Q Y F |
| 05.080 | TRBV05-1*01 | TRBJ2-7*01 | TRBD2*01 | 286 | tgcgccagcagcttgg | cgac | gga. | | ...ctacgagcagtactc | 1982 | C A S S L A T D Y E Q Y F |
| 05.081 | TRBV05-1*01 | TRBJ2-7*01 | TRBD1*01 | 287 | tgcgccagcagcttgg | c ..gacagg... | a | .tcctacgagcagtactc | | 1983 | C A S S L A T G S Y E Q Y F |
| 05.082 | TRBV05-4*01 | TRBJ2-3*01 | TRBD2*02 | 288 | tgtgccagcagcttgg | ccgt | ...cgggag... cg | ...cagatacgcagtatttt | | 1984 | C A S S L A V G S A D T Q Y F |
| 05.083 | TRBV05-1*02 | TRBJ2-1*01 | TRBD1*01 | 289 | tgcccagc..... | agcttagcgta cc gggacaggg... tagccctact ...tacaatgagcagttcttc | | | | 1985 | C A S S L A Y R D R V A L T Y N E Q F F |
| 05.084 | TRBV05-1*01 | TRBJ1-2*01 | TRBD2*01 | 290 | tgtgccagcagc ttggcttacgtta ..acta..... tggctact | | | | ...ccttc | 1986 | C A S S L A Y V N Y G Y S F |
| 05.085 | TRBV05-5*03 | TRBJ1-2*01 | | 291 | tgtgccagcagc ttggcttact taaclatgctacacctc | | | | | 1987 | C A S S L A Y V N Y G Y T F |
| 05.086 | TRBV05-1*01 | TRBJ2-4*01 | | 292 | tgcgccagcagcttgg atgatag | ........cattcagtactc | | | | 1988 | C A S S L D D S I Q Y F |
| 05.087 | TRBV05-1*01 | TRBJ2-3*01 | | 293 | tgcgccagcagcttgg atttggaataaccg | ...cagatacgcagtatttt | | | | 1989 | C A S S L D F G I T A D T Q Y F |
| 05.088 | TRBV05-1*02 | TRBJ2-7*01 | TRBD2*01 | 294 | tgcgccagc..... | agcttgg atggc ggac... | | ....cctacgagcagtactc | | 1990 | C A S S L D G G P Y E Q Y F |
| 05.089 | TRBV05-4*01 | TRBJ1-5*01 | TRBD1*01 | 295 | tgtgccagcagc... | ct ..ggac.... | ggaaa | ...caatcagcccagcattt | | 1991 | C A S S L D G N N Q P Q H F |
| 05.090 | TRBV05-1*01 | TRBJ2-6*01 | | 296 | tgtgccagcagcttgg acaaa ctctgggggccaacgtcctgacttc | | | | | 1992 | C A S S L D N S G A N V L T F |
| 05.091 | TRBV05-5*01 | TRBJ2-3*01 | TRBD1*01 | 297 | tgtgccagcagcttgg | ..acaggg... | cctgggaa | ........acgcagtatttt | | 1993 | C A S S L D R A W E T Q Y F |
| 05.092 | TRBV05-5*03 | TRBJ2-5*01 | TRBD1*01 | 298 | tgtgccagcagc tt ggacaggggg | .....gagaccccagtactc | | | | 1994 | C A S S L D R G E T Q Y F |
| 05.093 | TRBV05-1*02 | TRBJ2-1*01 | TRBD2*01 | 299 | tgccagc..... | agctt .ggact..... | cctg | ...caatgagcagttcttc | | 1995 | C A S S L D S C N E Q F F |
| 05.094 | TRBV05-1*02 | TRBJ2-1*01 | | 300 | tgcgccagc..... | agcttgga ctcctacaatgagcagttcttc | | | | 1996 | C A S S L D S Y N E Q F F |
| 05.095 | TRBV05-5*03 | TRBJ2-5*01 | TRBD1*01 | 301 | tgtgccagcagc ttggaagctgg c gggacaggg... t accaagagaccccagtactc | | | | | 1997 | C A S S L E A G G T G Y Q E T Q Y F |
| 05.096 | TRBV05-4*01 | TRBJ2-3*01 | TRBD1*01 | 302 | tgtgccagcagcttgg | ...agggggc aggttga | .....atacgcagtatttt | | | 1998 | C A S S L E G A G L N T Q Y F |
| 05.097 | TRBV05-1*01 | TRBJ1-1*01 | TRBD2*01 | 303 | tgtgccagcagctgg agggac | ...cgggggg..... | acactgaagcttcttt | | | 1999 | C A S S L E G P G D T E A F F |
| 05.098 | TRBV05-1*01 | TRBJ2-5*01 | TRBD2*01 | 304 | tgcgccagcagcttgg aa ..gga | ........caagagaccccagtactc | | | | 2000 | C A S S L E G Q E T Q Y F |
| 05.099 | TRBV05-6*01 | TRBJ2-1*01 | TRBD2*02 | 305 | tgtgccagcagcttgg agggc ..agcggaggg cc tatcga | .......gagcagttcttc | | | | 2001 | C A S S L E G S G R A Y R E Q F F |

Figure 1-12

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 05.100 | TRBV05-5*03 | TRBJ2-3*01 | TRBD2*02 | 306 | tgtgccagcagc tt | | ggag. tctgcctg | ..acagatacgcagtattt | | 2002 | C A S S L E S A L T D T Q Y F |
| 05.101 | TRBV05-1*01 | TRBJ2-7*01 | TRBD1*01 | 307 | tgcgccagcagcttg agtc | | ....cagg...... | acgagcagtactc | | 2003 | C A S S L E S R D E Q Y F |
| 05.102 | TRBV05-6*01 | TRBJ2-7*01 | TRBD2*02 | 308 | tgtgccagcagcttg. tt ...tagcgggag.. | | | t ....tacgagcagtactc | | 2004 | C A S S L F S G S Y E Q Y F |
| 05.103 | TRBV05-6*01 | TRBJ2-1*01 | TRBD2*02 | 309 | tgtgccagcagcttg. tttgt | | ....gcggaggg g | tcctacaatgagcagttcttc | | 2005 | C A S S L F V R E G S Y N E Q F F |
| 05.104 | TRBV05-1*01 | TRBJ2-7*01 | TRBD2*02 | 310 | tgcgccagcagcttgg ggg.... | | gcggaggg cc ttttgg | ...ctacgagcagtactc | | 2006 | C A S S L G A G G P F G Y E Q Y F |
| 05.105 | TRBV05-1*01 | TRBJ2-1*01 | TRBD2*02 | 311 | tgcgccagcagcttgg g | | ...agcggga.. atccaaaaggg | ...tacaatgagcagttcttc | | 2007 | C A S S L G A G I Q K G Y N E Q F F |
| 05.106 | TRBV05-1*01 | TRBJ2-3*01 | TRBD2*02 | 312 | tgcgccagcagcttgg gtga | | .....cggag.. ctc | ..cacagatacgcagtattt | | 2008 | C A S S L G D G S S T D T Q Y F |
| 05.107 | TRBV05-5*01 | TRBJ2-5*01 | TRBD1*01 | 313 | tgtgccagcagcttgg gggacagggggc tggg | | | ...agagaccagtactc | | 2009 | C A S S L G D R G L G E T Q Y F |
| 05.108 | TRBV05-1*02 | TRBJ2-1*01 | TRBD1*01 | 314 | tg........ | tgccagcagcttgg gggacaggg.. | acaactatgatg | | ............agttcttc | 2010 | C A S S L G D R D N Y D E F F |
| 05.109 | TRBV05-4*01 | TRBJ2-2*01 | TRBD2*02 | 315 | tgcgccagcagcttgg ggggg ......clagcgggag.. tt | | | ......cgggagctgttttt | | 2011 | C A S S L G G P S G S S G E L F F |
| 05.110 | TRBV05-4*01 | TRBJ1-1*01 | TRBD1*01 | 316 | tgtgccagcagcttgg g ....gggacaggg.. | | ac | tgaacactgaagcttcttt | | 2012 | C A S S L G G Q G L N T E A F F |
| 05.111 | TRBV05-1*01 | TRBJ2-1*01 | | 317 | tgcgccagcagcttgg gtatcggtg g ctcctacaatgagcagttcttc | | | | | 2013 | C A S S L G I G G S Y N E Q F F |
| 05.112 | TRBV05-1*01 | TRBJ2-2*01 | TRBD2*01 | 318 | tgcgccagcagcttgg | | .........ggc ctgattggc | ..acaccggggagctgtttt | | 2014 | C A S S L G P D W H T G E L F |
| 05.113 | TRBV05-1*01 | TRBJ2-1*01 | TRBD1*01 | 319 | tgcgccagcagcttgg gacc ......ggac.. cgtgggt | | | .....caatgagcagttcttc | | 2015 | C A S S L G P D R G V N E Q F F |
| 05.114 | TRBV05-1*01 | TRBJ1-2*01 | TRBD2*01 | 320 | tgcgccagcagcttgg gacc ..gaca..... | | ctcc | ....atgctacacctc | | 2016 | C A S S L G P T L H G Y T F |
| 05.115 | TRBV05-5*03 | TRBJ1-3*01 | TRBD1*01 | 321 | tgtgccagcagc tta ggacaggg.. ctctggaaacaccatatattt | | | | | 2017 | C A S S L G Q G S G N T I Y F |
| 05.116 | TRBV05-6*01 | TRBJ1-4*01 | TRBD1*01 | 322 | tgtgccagcagcttgg g ....cagggg.. ctac ........gaaaaactgtttt | | | | | 2018 | C A S S L G R G Y E K L F F |
| 05.117 | TRBV05-6*01 | TRBJ2-3*01 | TRBD2*01 | 323 | tgtgccagcagcttgg ggc ..gacta. | | ......tcaactggcg | ...cagatacgcagtattt | | 2019 | C A S S L G R L S H G A D T Q Y F |
| 05.118 | TRBV05-1*01 | TRBJ1-3*01 | TRBD1*01 | 324 | tgcgccagcagcttgg ga ......agcg..... | | ctt ctctggaaacaccatatattt | | | 2020 | C A S S L G S A F S G N T I Y F |
| 05.119 | TRBV05-5*01 | TRBJ1-1*01 | TRBD1*01 | 325 | tgtgccagcagcttgg ggt | | ....cagggg. gttttgt | .....actgaagcttcttt | | 2021 | C A S S L G S G G F G T E A F F |
| 05.120 | TRBV05-1*01 | TRBJ2-6*01 | TRBD1*01 | 326 | tgtgccagcagcttgg gtt | | ...cagggg. gaatccaag ctctgggggccaacgtcctgacttc | | | 2022 | C A S S L G S G G N P S S G A N V L T F |
| 05.121 | TRBV05-1*01 | TRBJ1-1*01 | TRBD1*01 | 327 | tgcgccagcagcttgg gatcgg | | .....ggggc ctt | ..acactgaagcttcttt | | 2023 | C A S S L G S G G P Y T E A F F |
| 05.122 | TRBV05-2*01 | TRBJ2-2*01 | TRBD1*01 | 328 | tgtgccagcagcttgg gttcc | | ......cgg..... ccacgctt. gaacaccggggagctgtttt | | | 2024 | C A S S L G S R P R L N T G E L F F |
| 05.123 | TRBV05-6*01 | TRBJ1-1*01 | TRBD1*01 | 329 | tgtgccagcagcttgg | | ggacaggggc ttgt | ..acactgaagcttcttt | | 2025 | C A S S L G T G G L Y T E A F F |
| 05.124 | TRBV05-1*02 | TRBJ1-2*01 | TRBD1*01 | 330 | tgggccagc...... agcttg gggacaggg.. | | ....ctatgctacacctc | | | 2026 | C A S S L G T G G Y G Y T F |
| 05.125 | TRBV05-1*01 | TRBJ2-3*01 | TRBD1*01 | 331 | tgcgccagcagc... ctc gggacaggg.. aggg | | | ....cagatacgcagtattt | | 2027 | C A S S L G T G R A D T Q Y F |
| 05.126 | TRBV05-1*01 | TRBJ2-1*01 | TRBD2*02 | 332 | tgcgccagcagcttgg gtacagg ....cggga.. | | cg | ....atgagcagttcttc | | 2028 | C A S S L G T G R D D E Q F F |
| 05.127 | TRBV05-1*01 | TRBJ1-1*01 | TRBD2*01 | 333 | tgcgccagcagcttgg ggaccaccga | | ..actagacgggg...... | ...........agttcttc | | 2029 | C A S S L G T T E L A G E F F |

Figure 1-13

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 05.128 | TRBV05-6*01 | TRBJ2-7*01 | TRBD2*01 | 334 | tgtgccagcagc.... | ctt | gggac........... | gtggaa ...ctacgagcagtacttc | | 2030 | C A S S L G T W N Y E Q Y F |
| 05.129 | TRBV05-6*01 | TRBJ2-7*01 | TRBD2*02 | 335 | tgtgccagcagcttgg | ggg | ...tagcggagg. | tttga | .....acgagcagtacttc | 2031 | C A S S L G V A G G L N E Q Y F |
| 05.130 | TRBV05-6*01 | TRBJ2-5*01 | TRBD1*01 | 336 | tgtgccagcagcttgg | gtgttt | ...cagg.. | ttga | ....agacccagtacttc | 2032 | C A S S L G V S G L K T Q Y F |
| 05.131 | TRBV05-4*01 | TRBJ2-7*01 | TRBD2*02 | 337 | tgtgccagcagctt.. | aggcgt | ....tacgggag. | | ......cgagcagtacttc | 2033 | C A S S L G V S G S E Q Y F |
| 05.132 | TRBV05-6*01 | TRBJ1-1*01 | | 338 | tgtgccagcagcttgg | gtgtgagtt | ...acactgaagcttcttt | | | 2034 | C A S S L G V S Y T E A F F |
| 05.133 | TRBV05-1*02 | TRBJ2-1*01 | TRBD2*02 | 339 | tgtgccagc........ | agcttgggtg | .......gcgggag.. | acttacgatgagcac .......tcttc | | 2035 | C A S S L G W R E T Y D E H F F |
| 05.134 | TRBV05-1*02 | TRBJ2-1*01 | TRBD2*02 | 340 | tgcgccagc....... | agcttgggtg | .......gcgggag.. | acttacg | .......atgagcagttcttc | 2036 | C A S S L G W R E T Y D E Q F F |
| 05.135 | TRBV05-1*01 | TRBJ2-1*01 | TRBD2*02 | 341 | tgcgccagc........ | agcttgggtg | .......gcgggag.. | gcc.act... | tacaatgagcagttcttc | 2037 | C A S S L G W R E T Y N E Q F F |
| 05.136 | TRBV05-5*03 | TRBJ1-1*01 | TRBD1*01 | 342 | tgtgccagcagc | ctcattccgt | ......gggag. | taacgagtatc | .......atgagcagttcttc | 2038 | C A S S L I P V G V T S Y H E Q F F |
| 05.137 | TRBV05-5*03 | TRBJ1-2*01 | TRBD1*01 | 343 | tgtgccagcagc | ttgttag | ...caggggtg | a ..aactatgctacacctc | | 2039 | C A S S L L A G G N Y G Y T F |
| 05.138 | TRBV05-1*01 | TRBJ1-1*01 | TRBD1*01 | 344 | tgtgccagcagcttgg | ttg | .......ggggc | ttggg ....cactgaagcttcttt | | 2040 | C A S S L L G G L G T E A F F |
| 05.139 | TRBV05-5*03 | TRBJ2-1*01 | TRBD2*02 | 345 | tgcgccagcagc.... | ctcttg | .........gggag.. | cgccaaa.... | tacaatgagcagttcttc | 2041 | C A S S L L G S A K Y N E Q F F |
| 05.140 | TRBV05-1*02 | TRBJ2-3*01 | TRBD2*02 | 346 | tgcgccagc........ | agcctcttgaa | ......ggag.. | aagg | ....cagatacgcagtattt | 2042 | C A S S L L K E K A D T Q Y F |
| 05.141 | TRBV05-1*01 | TRBJ2-3*01 | TRBD2*02 | 347 | tgcgccagcagctg.. | tta | ....cgggag.. | catca | .....agatacgcagtattt | 2043 | C A S S L L R E H Q D T Q Y F |
| 05.142 | TRBV05-1*01 | TRBJ2-3*01 | TRBD2*02 | 348 | tgcgccagcagcttg. | tta | ....cgggag.. | catcg | ....agatacgcagtattt | 2044 | C A S S L L R E H R D T Q Y F |
| 05.143 | TRBV05-1*01 | TRBJ2-3*01 | TRBD2*02 | 349 | tgcgccagcagc.... | ctctt | .........gaggg | agaagg | ...cagatacgcagtattt | 2045 | C A S S L L R E K A D T Q Y F |
| 05.144 | TRBV05-1*01 | TRBJ2-3*01 | TRBD2*02 | 350 | tgcgccagcagcttg. | tt | .......gcggga.. | a | agcacagatacgcagtattt | 2046 | C A S S L L R E S T D T Q Y F |
| 05.145 | TRBV05-5*01 | TRBJ2-5*01 | TRBD2*02 | 351 | tgtgccagcagcttg. | ctat | .......cggagg | ggg | ....gagaccagtacttc | 2047 | C A S S L L S G G G E T Q Y F |
| 05.146 | TRBV05-6*01 | TRBJ1-2*01 | TRBD1*01 | 352 | tgtgccagcagc.... | ctgatcg | .......aggg.. | tag | ....ctatgctacacctc | 2048 | C A S S L M E G S Y G Y T F |
| 05.147 | TRBV05-1*01 | TRBJ2-1*01 | TRBD1*01 | 353 | tgcgccagcagcttg. | aatgc | ..actacgcg | tg | .....aatgagcagttcttc | 2049 | C A S S L N A L A V N E Q F F |
| 05.148 | TRBV05-6*01 | TRBJ2-5*01 | | 354 | tgtgccagcagcttg. | aatgaagg | ...aagagaccagtacttc | | | 2050 | C A S S L N E E E T Q Y F |
| 05.149 | TRBV05-6*01 | TRBJ2-3*01 | TRBD2*01 | 355 | tgtgccagcagcttg. | cg | ......agcgggg.. | tgggaagaaga | ..cacagatacgcagtattt | 2051 | C A S S L R A G W E E D T D T Q Y F |
| 05.150 | TRBV05-5*03 | TRBJ2-7*01 | TRBD2*02 | 356 | tgtgccagcagc | ttacgg | .....gcgggaggg | c tag | ....acgagcagtacttc | 2052 | C A S S L R A G G L D E Q Y F |
| 05.151 | TRBV05-1*01 | TRBJ1-1*01 | TRBD1*01 | 357 | tgcgccagcagcttg. | cgattat | ..acag.... | ccat | ..aacactgaagcttcttt | 2053 | C A S S L R L Y S H N T E A F F |
| 05.152 | TRBV05-6*01 | TRBJ2-7*01 | TRBD1*01 | 358 | tgtgccagcagc.... | ctac | ..gacag..... | tcccc | ....cgagcagtacttc | 2054 | C A S S L R Q S P E Q Y F |
| 05.153 | TRBV05-6*01 | TRBJ2-1*01 | TRBD1*01 | 359 | tgtgccagcagcttg. | cg | ....cagg..... | | ....gagcagttcttc | 2055 | C A S S L R R E Q F F |
| 05.154 | TRBV05-1*01 | TRBJ2-1*01 | TRBD1*01 | 360 | tgcgccagcagcttg. | t | ....caggggg | | ...ctacaatgagcagttcttc | 2056 | C A S S L S G G Y N E Q F F |
| 05.155 | TRBV05-4*01 | TRBJ2-1*01 | TRBD2*02 | 361 | tgtgccagcagctt.. | at c | gggactagcgggag.. | ttcg... | ...tgagcagttcttc | 2057 | C A S S L S G L A G V R E Q F F |

Figure 1-14

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 05.156 | TRBV05-1*01 | TRBJ2-7*01 | TRBD1*01 | 362 | tgcgccagcagcttg | tc | gggc aggaagcta | tcctacgagcagtactc | | 2058 | C A S S L S G R K V S Y E Q Y F |
| 05.157 | TRBV05-6*01 | TRBJ1-1*01 | TRBD1*01 | 363 | tgtgccagcagcttt | aag | caggggc | g | agcttcttt | 2059 | C A S S L S R G R A F F |
| 05.158 | TRBV05-1*01 | TRBJ2-5*01 | TRBD2*01 | 364 | tgcgccagcagcttg | tcg | agcg | atatctc | ccaagagaccagtactc | 2060 | C A S S S D I S Q E T Q Y F |
| 05.159 | TRBV05-5*03 | TRBJ2-7*01 | | 365 | tgtgccagcagc | ttaactg | cctacgagcagtactc | | | 2061 | C A S S L T A Y E Q Y F |
| 05.160 | TRBV05-1*01 | TRBJ2-1*01 | TRBD2*01 | 366 | tgcgccagcagc | ac | cgggg | ctcctacaatgagcagttctc | | 2062 | C A S S L T G G S Y N E Q F F |
| 05.161 | TRBV05-6*01 | TRBJ2-1*01 | TRBD1*01 | 367 | tgtgccagcagcttgg | t | ggggg | aaagg | gagcagttctc | 2063 | C A S S L V G E R E Q F F |
| 05.162 | TRBV05-1*02 | TRBJ2-5*01 | TRBD2*02 | 368 | tgcgccagc | agcttgttg | gcgggag | attc | gagaccagtactc | 2064 | C A S S L V G G R F E T Q Y F |
| 05.163 | TRBV05-1*01 | TRBJ2-5*01 | TRBD2*01 | 369 | tgtgccagcagcttgg | tg | ggga | tc | gagaccagtactc | 2065 | C A S S L V G I E T Q Y F |
| 05.164 | TRBV05-8*01 | TRBJ2-1*01 | | 370 | tgtgccagcagctgg | tact | tgagcagttctc | | | 2066 | C A S S L V L E Q F F |
| 05.165 | TRBV05-5*01 | TRBJ2-5*01 | TRBD1*01 | 371 | tgcgccagcagcttc | t | gggac | gcggtg | aagagaccagtactc | 2067 | C A S S L W D G G E E T Q Y F |
| 05.166 | TRBV05-1*01 | TRBJ2-5*01 | TRBD1*01 | 372 | tgcgccagc | agcttgt | ggac | ccgtatt | accaagagaccagtactc | 2068 | C A S S L W T R I Y Q E T Q Y F |
| 05.167 | TRBV05-1*01 | TRBJ2-1*01 | TRBD2*01 | 373 | tgcgccagcagcttg | tatttggggttgag | gggac | | atgagcagttctc | 2069 | C A S S L Y L G V R G H E Q F F |
| 05.168 | TRBV05-1*01 | TRBJ2-1*01 | TRBD2*02 | 374 | tgtgccagcagcttg | tatcttt | gag | ctcctacaat | gagcagttctc | 2070 | C A S S L Y P L S S Y N E Q F F |
| 05.169 | TRBV05-6*01 | TRBJ2-5*01 | TRBD1*01 | 375 | tgtgccagcagc | atgtttgt | ggggc | t | gagaccagtactc | 2071 | C A S S M F L V G A E T Q Y F |
| 05.170 | TRBV05-1*01 | TRBJ1-1*01 | TRBD2*01 | 376 | tgcgccagcag | taat | gact | t | cactgaagcttctt | 2072 | C A S S N D F T E A F F |
| 05.171 | TRBV05-1*01 | TRBJ2-7*01 | TRBD2*01 | 377 | tgcgccagcagc | c | ogg | ccga | ctacgagcagtactc | 2073 | C A S S P A D Y E Q Y F |
| 05.172 | TRBV05-8*01 | TRBJ2-7*01 | TRBD2*01 | 378 | tgcgccagcagc | cccg | c gggactagcgg | a | ctacgagcagtactc | 2074 | C A S S P A G L A D Y E Q Y F |
| 05.173 | TRBV05-4*01 | TRBJ2-1*01 | TRBD2*01 | 379 | tgtgccagcagc | cccgagcgcca | gggac | g | atgagcagttctc | 2075 | C A S S P D A R D D E Q F F |
| 05.174 | TRBV05-1*01 | TRBJ1-1*01 | | 380 | tgtgccagcagc | cctttac | aacactgaagcttctt | | | 2076 | C A S S P F Y N T E A F F |
| 05.175 | TRBV05-5*01 | TRBJ2-1*01 | TRBD1*01 | 381 | tgtgccagcagc | ccc | ggacagg | tctggt | caatgagcagttctc | 2077 | C A S S P G Q G L V N E Q F F |
| 05.176 | TRBV05-1*01 | TRBJ2-2*01 | TRBD2*02 | 382 | tgcgccagcagc | cccgga | ccgga | gaacaccgggagctgttttt | | 2078 | C A S S P G R E N T G E L F F |
| 05.177 | TRBV05-1*02 | TRBJ2-7*01 | TRBD1*01 | 383 | tgcgccagc | agccct | gggacagggg | tagc | ggagcagtactc | 2079 | C A S S P G T G V A E Q Y F |
| 05.178 | TRBV05-6*01 | TRBJ2-7*01 | TRBD2*01 | 384 | tgtgccagcagc | ccaggt | ggggg | cctacgagcagtactc | | 2080 | C A S S P G W G A Y E Q Y F |
| 05.179 | TRBV05-8*01 | TRBJ2-1*01 | TRBD1*01 | 385 | tgtgccagcagc | ccgtagt | aggggg | aa | cctacaatgagcagttctc | 2081 | C A S S P L V G G T Y N E Q F F |
| 05.180 | TRBV05-6*01 | TRBJ2-2*01 | TRBD1*01 | 386 | tgtgccagcagc | ccccc | gacaggg | aggg | ccgggagctgttttt | 2082 | C A S S P P T G R A G E L F F |
| 05.181 | TRBV05-1*01 | TRBD2*01 | TRBD2*01 | 387 | tgcgccagcag | tc | ctagcggggg | t | tacaatgagcagttctc | 2083 | C A S S P S G G Y N E Q F F |
| 05.182 | TRBV05-1*02 | TRBJ2-5*01 | TRBD1*01 | 388 | tgtgccagc | agcccgtctccctac | cagg | gagaccagtactc | | 2084 | C A S S P V S P T R E T Q Y F |
| 05.183 | TRBV05-4*01 | TRBJ2-2*01 | TRBD2*01 | 389 | tgtgccagcagc | ccttggg | gcggggg | cgag | ccggggagctgttttt | 2085 | C A S S P W G G G R A G E L F F |

Figure 1-15

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 05.184 | TRBV05-1*01 | TRBJ2-1*01 | TRBD2*02 | 390 | tgtgccagcagc.... | ccgt. | ggactagcgggaggg | ccgg | ......gttcttc | 2086 | C A S S P W T S G R A G F F |
| 05.185 | TRBV05-4*01 | TRBJ2-1*01 | TRBD1*01 | 391 | tgtgccagcagc.. | ca gggaca..... | cc g ctcctacaatgagcagttcttc | | | 2087 | C A S S Q G H R S Y N E Q F F |
| 05.186 | TRBV05-5*01 | TRBJ2-1*01 | TRBD2*01 | 392 | tgtgccagcagc.... | ca gggactagcggg... | cc ...cctacaatgagcagttcttc | | | 2088 | C A S S Q G L A G P Y N E Q F F |
| 05.187 | TRBV05-5*03 | TRBJ2-3*01 | TRBD1*01 | 393 | tgtgccagcagc cgcat | .....aggggg. | tt ...cagatacgcagtattt | | | 2089 | C A S S R I G G S D T Q Y F |
| 05.188 | TRBV05-1*01 | TRBJ2-7*01 | TRBD2*02 | 394 | tgtgccagcagc.... | cgaataccactaaca | .....agcgggaggg cc gattgg | .......gagcagtactc | | 2090 | C A S S R I P L T S G R A D W E Q Y F |
| 05.189 | TRBV05-1*01 | TRBJ1-1*01 | TRBD1*01 | 395 | tgtgccagcagc..... | ccpaat gggacaggg... | acg .....actgaagcttctc | | | 2091 | C A S S R M G Q G R T E A F F |
| 05.190 | TRBV05-1*01 | TRBJ2-1*01 | TRBD2*02 | 396 | tgtgccagcagc.... | a ....... | ggaggg gtcgccgaccgt | .....aatgagcagttcttc | | 2092 | C A S S R R G A D R N E Q F F |
| 05.191 | TRBV05-1*01 | TRBJ2-1*01 | TRBD2*02 | 397 | tgtgccagcagct... | c ........ | agcgggagg... | .ctacaatgagcagttcttc | | 2093 | C A S S A G G Y N E Q F F |
| 05.192 | TRBV05-6*01 | TRBJ2-6*01 | TRBD2*02 | 398 | tgtgccagcagct... | cc .......... | gaggg cc t ctctgggggccaaacgtcctgactctc | | | 2094 | C A S S E G L S G A N V L T F |
| 05.193 | TRBV05-1*01 | TRBJ2-7*01 | TRBD1*01 | 399 | tgtgccagcagct... | c gggacaggg... | ta ...cctacgagcagtactc | | | 2095 | C A S S G Q G T Y E Q Y F |
| 05.194 | TRBV05-6*01 | TRBJ2-3*01 | TRBD1*01 | 400 | tgtgccagcagct... | ca gggacag.... | acttc ..cacagatacgcagtattt | | | 2096 | C A S S G T D F S T D T Q Y F |
| 05.195 | TRBV05-6*01 | TRBJ2-1*01 | TRBD2*02 | 401 | tgtgccagcagct... | cta ...tagcgggag. | cttgg ......caatgagcagttcttc | | | 2097 | C A S S I A G A G N E Q F F |
| 05.196 | TRBV05-5*01 | TRBJ2-5*01 | | 402 | tgtgccagcagct..... | ccatatcc ...gagaccagtactc | | | | 2098 | C A S S I S E T Q Y F |
| 05.197 | TRBV05-4*01 | TRBJ2-3*01 | | 403 | tgtgccagcag..... | ttctatgtctcgcgcc ct agcacagatacgcagtattt | | | | 2099 | C A S S I V S R P S T D T Q Y F |
| 05.198 | TRBV05-2*01 | TRBJ2-2*01 | TRBD1*01 | 404 | tgtgccagcagct.... | ccctg ...ctagcgggg... | atag ..acaccgggagctgttttt | | | 2100 | C A S S L L A G I D T G E L F F |
| 05.199 | TRBV05-4*01 | TRBJ2-7*01 | TRBD1*01 | 405 | tgtgccagcagct... | cccca ..ggacaggga... | a ...cctacgagcagtactc | | | 2101 | C A S S P G Q G T Y E Q Y F |
| 05.200 | TRBV05-4*01 | TRBJ2-1*01 | TRBD2*01 | 406 | tgtgccagcagct... | cccccc ...ctag...... | t ......aatgagcagttcttc | | | 2102 | C A S S P P P S N E Q F F |
| 05.201 | TRBV05-4*01 | TRBJ2-7*01 | TRBD2*02 | 407 | tgtgccagcagct... | cccc ..gactagcgga... | c ctcctacgagcagtactc | | | 2103 | C A S S P T S G T S Y E Q Y F |
| 05.202 | TRBV05-6*01 | TRBJ2-7*01 | TRBD2*02 | 408 | tgtgccagcag..... | ttctc ......agcgggaggg cc t ...ctacgagcagtactc | | | | 2104 | C A S S Q R E G L Y E Q Y F |
| 05.203 | TRBV05-4*01 | TRBJ2-7*01 | TRBD2*01 | 409 | tgtgccagcagct..... | ctagcg... | agg ..cctacgagcagtactc | | | 2105 | C A S S S E A Y E Q Y F |
| 05.204 | TRBV05-1*01 | TRBJ2-1*01 | TRBD2*01 | 410 | tgtgccagcagct.... | .....ctagcgggg... | .ctacaatgagcagttcttc | | | 2106 | C A S S S G A Y N E Q F F |
| 05.205 | TRBV05-6*01 | TRBJ1-1*01 | TRBD1*01 | 411 | tgtgccagcagct.... | cctcaaaaa gga....... | tat tgaacactgaagcttctt | | | 2107 | C A S S S K R I L N T E A F F |
| 05.206 | TRBV05-1*01 | TRBJ2-3*01 | TRBD2*02 | 412 | tgtgccagcagct.. | c ..gactacgga... | to ....cagatacgcagtatttt | | | 2108 | C A S S S P D T Q Y F |
| 05.207 | TRBV05-6*01 | TRBJ2-1*01 | TRBD2*01 | 413 | tgtgccagcagct.. | c ..gactacg... | tgag ctcctacaatgagcagttcttc | | | 2109 | C A S S T S V S S Y N E Q F F |
| 05.208 | TRBV05-8*01 | TRBJ2-5*01 | TRBD1*01 | 414 | tgtgccagcagc.... | acga .ggac..... | ggag ....gagaccagtactc | | | 2110 | C A S S T R T E E T Q Y F |
| 05.209 | TRBV05-1*01 | TRBJ2-1*01 | TRBD2*01 | 415 | tgtgccagcag..... | tactc ...... | ccgggg ....cctacaatgagcagttcttc | | | 2111 | C A S S T S G A Y N E Q F F |
| 05.210 | TRBV05-1*01 | TRBJ2-2*01 | TRBD2*02 | 416 | tgtgccagcag..... | ac ..gactagcgggag... | gaacaccgggagctgttttt | | | 2112 | C A S S T T S G R N T G E L F F |
| 05.211 | TRBV05-1*01 | TRBJ2-3*01 | TRBD2*02 | 417 | tgtgccagcagc..... | gtc ....gccggga... | tc ..cacagatacgcagtatttt | | | 2113 | C A S S V A G S T D T Q Y F |

Figure 1-16

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 05.212 | TRBV05-1*01 | TRBJ2-7*01 | TRBD2*01 | 418 | tgcgccagcagc... | gt | ...cgt...... | tgag | ......gagcagtactlc | 2114 | C A S S V G E E Q Y F |
| 05.213 | TRBV05-1*01 | TRBJ1-2*01 | TRBD1*01 | 419 | tgcgccagcagct... | ggg | cc gggacaggggg. | ...clatggctacacctlc | 2115 | C A S S W A G T G G Y G Y T F |
| 05.214 | TRBV05-1*01 | TRBJ2-1*01 | TRBD1*01 | 420 | tgcgccagcagct... | gggacagg... | tct | .......atgagcagttcttc | 2116 | C A S S W D R V Y E Q F F |
| 05.215 | TRBV05-1*01 | TRBJ2-5*01 | TRBD2*01 | 421 | tgcgccagcagt... | ........ggggggg | ggcctactcatc. | ccaagagaccagtactlc | 2117 | C A S S W G G A Y S S Q E T Q Y F |
| 05.216 | TRBV05-1*01 | TRBJ2-1*01 | TRBD2*01 | 422 | tgcgccagcagct... | ....... | ggggggg gcgggaaact. | ..tacaatgagcagttcttc | 2118 | C A S S W G G R E T Y N E Q F F |
| 05.217 | TRBV05-1*01 | TRBJ2-1*01 | TRBD1*01 | 423 | tgcgccagcagt... | gg | gggacagggg. | ccggg | ........gagcagttcttc | 2119 | C A S S W G T G A G E Q F F |
| 05.218 | TRBV05-1*01 | TRBJ2-1*01 | TRBD1*01 | 424 | tgcgccagcagct... | gg | gggacagg... | ffccgtgac. | ........cagtlcttc | 2120 | C A S S W G T G S G D Q F F |
| 05.219 | TRBV05-1*01 | TRBJ2-1*01 | TRBD1*01 | 425 | tgcgccagcagt... | gg | gggacaggg... | tccgg | ........tgagcagttcttc | 2121 | C A S S W G T G S G E Q F F |
| 05.220 | TRBV05-6*01 | TRBJ2-3*01 | TRBD2*01 | 426 | tgcgccagcagt... | ggaa | ggac...... | gccgcc | .gcagagatacgcagtattt | 2122 | C A S S W K G R R R T D T Q Y F |
| 05.221 | TRBV05-6*01 | TRBJ1-2*01 | TRBD1*01 | 427 | tgtgccagcagt... | ggtcagcc | g ctaactatggctacacctlc | | | 2123 | C A S S W S A A N Y G Y T F |
| 05.222 | TRBV05-6*01 | TRBJ2-7*01 | TRBD1*01 | 428 | tgtgccagcagt... | at | .......ggggg | tt | ..ctacgagcagtactlc | 2124 | C A S S Y G G F Y E Q Y F |
| 05.223 | TRBV05-8*01 | TRBJ1-1*01 | TRBD2*01 | 429 | tgtgccagcagct... | a | c gggact........ | gc | ...cactgaagcttcttt | 2125 | C A S S Y G T A T E A F F |
| 05.224 | TRBV05-1*01 | TRBJ1-1*01 | TRBD1*01 | 430 | tgcgccagcagt... | ac | gggacagg... | to | ...cactgaagcttcttt | 2126 | C A S S Y G T G S T E A F F |
| 05.225 | TRBV05-4*01 | TRBJ1-5*01 | | 431 | tgtgccagcagct... | acct | ..caatcagcccagcattt | | | 2127 | C A S S Y L N Q P Q H F |
| 05.226 | TRBV05-6*01 | TRBJ2-5*01 | TRBD1*01 | 432 | tgtgccagca...... | ccaa | .gacagg...... | cctlaaggg... | gagaccagtactlc | 2128 | C A S T K T G L K G E T Q Y F |
| 05.227 | TRBV05-1*01 | TRBJ2-1*01 | TRBD2*02 | 433 | tgcgccagca...... | cctgcc | ...... | ggag. | ...cctacaatgagcagtlcttc | 2129 | C A S T L A G A Y N E Q F F |
| 05.228 | TRBV05-1*01 | TRBJ2-1*01 | TRBD2*01 | 434 | tgcgccagca...... | ctccgg | ......gcggggg. | ... | ...tacaatgagcagttcttc | 2130 | C A S T P G G G Y N E Q F F |
| 05.229 | TRBV05-4*01 | TRBJ2-2*01 | TRBD2*01 | 435 | tgtgccagca...... | cccco | ...... | cggga... | atcccta | ........ggggagclgttttt | 2131 | C A S T P R G S L G E L F F |
| 05.230 | TRBV05-6*01 | TRBJ2-1*01 | TRBD1*01 | 436 | tgtgcca......... | cctcctttg gggac... | cgggcctacaatgac | ............cagtlcttc | 2132 | C A T S F G D R A Y N D Q F F |
| 05.231 | TRBV05-6*01 | TRBJ2-1*01 | TRBD1*01 | 437 | tgtgcca......... | ccagcttg gggacaggg... | cctacaatgagcagttcttc | | 2133 | C A T S F G D R A Y N E Q F F |
| 05.232 | TRBV05-4*01 | TRBJ2-1*01 | TRBD1*01 | 438 | tgtgcc.......... | gtaaggaccg | ...agggggg gat | ....caatgagcagttcttc | 2134 | C A V R T E G A I N E Q F F |
| 06.001 | TRBV06-1*01 | TRBJ1-1*01 | TRBD2*01 | 439 | tgtgcc.......... | ggcagtggt...acag... | a .gaacactgaagcttcttt | | 2135 | C A G S G T E N T E A F F |
| 06.002 | TRBV06-1*01 | TRBJ2-7*01 | TRBD1*01 | 440 | tgtgcca......... | ttc | .......gaggg gata | ...cctacgagcagtactlc | 2136 | C A I R G D T Y E Q Y F |
| 06.003 | TRBV06-6*01 | TRBJ2-7*01 | TRBD1*01 | 441 | tgtgcca......... | tctcgtct ...cagg... | ttttgaaa | .....acgagcagtactlc | 2137 | C A I S S Q G L E N E Q Y F |
| 06.004 | TRBV06-3*01 | TRBJ2-1*01 | TRBD2*02 | 442 | tgtgcca......... | gcga | ....tagcgggaggg ata | .......aatgagcagttcttc | 2138 | C A S A I A G G I N E Q F F |
| 06.005 | TRBV06-1*01 | TRBJ2-1*01 | TRBD2*01 | 443 | tgtgccagc....... | gcaaagcgtgt gggactacgcgg..... | a | ...ctacaatgagcagtlcttc | 2139 | C A S A K R V G L A D Y N E Q F F |
| 06.006 | TRBV06-1*01 | TRBJ2-7*01 | TRBD2*01 | 444 | tgtgccagc....... | gctt | ....cggggggg | gac | ag ctcctacgagcagtactlc | 2140 | C A S A S G G D S S Y E Q Y F |

Figure 1-17

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.007 | TRBV06-6*01 | TRBJ1-1*01 | | 445 | tgtgccagc | | tgaagcttcttt | | | 2141 | C A S E A F F |
| 06.008 | TRBV06-1*01 | TRBJ1-4*01 | TRBD2*02 | 446 | tgtgccagc | | gagg..cagt | ..taatgaaaactgttttt | | 2142 | C A S E A V N E K L F F |
| 06.009 | TRBV06-5*01 | TRBJ2-5*01 | TRBD1*01 | 447 | tgtgccagc | ggagcc | ......gggc.tgat | ....gacccagtacttc | | 2143 | C A S G A G L M T Q Y F |
| 06.010 | TRBV06-5*01 | TRBJ2-7*01 | TRBD1*01 | 448 | tgtgccag | tg.gggacaggg | ...caa | ...acgagcagtacttc | | 2144 | C A S G D R A N E Q Y F |
| 06.011 | TRBV06-5*01 | TRBJ1-2*01 | TRBD1*01 | 449 | tgtgccagc | gg c gggacaggggg | a | ...tatggctacacctc | | 2145 | C A S G G G T G G Y G Y T F |
| 06.012 | TRBV06-1*01 | TRBJ2-1*01 | TRBD2*01 | 450 | tgtgccagc | ggcagc ccc | gggactagcgg | ...cgga ........aatgagcagttcttc | | 2146 | C A S G S P G T S G G N E Q F F |
| 06.013 | TRBV06-5*01 | TRBJ2-5*01 | TRBD1*01 | 451 | tgtgccagca | togacc | ..ggacaggg | ... cccggg.....gagaccagtacttc | | 2147 | C A S I D R T G P G E T Q Y F |
| 06.014 | TRBV06-5*01 | TRBJ2-3*01 | TRBD2*02 | 452 | tgtgccagca | to | .ggactagcggagg. | tat .....agatacgcagtattt | | 2148 | C A S I G L A G G I D T Q Y F |
| 06.015 | TRBV06-5*01 | TRBJ2-5*01 | TRBD1*01 | 453 | tgtgccagca | agggac | ...cagggg | ...cagagccccat ........tacttc | | 2149 | C A S K G P G A E A H Y F |
| 06.016 | TRBV06-6*04 | TRBJ2-5*01 | TRBD1*01 | 454 | tgtgccagca | agggac | ...cagggg | ..cagagg ......cccagtacttc | | 2150 | C A S K G P G A E A Q Y F |
| 06.017 | TRBV06-5*01 | TRBJ1-5*01 | TRBD1*01 | 455 | tgtgccagca | aactc | .ggacaggg | ...ttccggg ...tcagcccagcatttt | | 2151 | C A S K L G Q V P G Q P Q H F |
| 06.018 | TRBV06-5*01 | TRBJ2-7*01 | TRBD1*01 | 456 | tgtgccagca | aattaac | .gacag | ....cca ...cctacgagcagtacttc | | 2152 | C A S K L T T A T Y E Q Y F |
| 06.019 | TRBV06-2*01 | TRBJ2-2*01 | TRBD2*01 | 457 | tgtgccagca | aatcttatc | ......gcgg | .....gaacaccgggagctgtttt | | 2153 | C A S K S Y R G N T G E L F F |
| 06.020 | TRBV06-1*01 | TRBJ2-7*01 | TRBD1*01 | 458 | tgtgccagca | agt | ..acaggggc.cta | ..cctacgagcagtacttc | | 2154 | C A S K Y R G P T Y E Q Y F |
| 06.021 | TRBV06-2*01 | TRBJ2-2*01 | TRBD1*01 | 459 | tgtgccagca | ctg | ...cagggg | .. aaca ...cctacgagcagtacttc | | 2155 | C A S L Q G N T Y E Q Y F |
| 06.022 | TRBV06-3*01 | TRBJ2-2*01 | TRBD2*01 | 460 | tgtgccagca | ttgagtta cc | oggacta | ..........cggggagctgtttt | | 2156 | C A S L S Y R D Y G E L F F |
| 06.023 | TRBV06-6*01 | TRBJ2-2*01 | TRBD1*01 | 461 | tgtgccagca | tgtc | .....ggggc.ctttgagct | ..acaccgggagctgtttt | | 2157 | C A S M S G P L S Y T G E L F F |
| 06.024 | TRBV06-6*01 | TRBJ2-2*01 | TRBD1*01 | 462 | tgtgccagca | tgtcc | ......gggc.ctatgacctacacctteqacctqtq.... | ttt | | 2158 | C A S M S G P M T Y T F E L C F |
| 06.025 | TRBV06-5*01 | TRBJ2-5*01 | TRBD2*01 | 463 | tgtgccagca | atccgct | ......gggggg | aggagtg....gagaccagtacttc | | 2159 | C A S N P L G G G V E T Q Y F |
| 06.026 | TRBV06-1*01 | TRBJ1-5*01 | TRBD1*01 | 464 | tgtgccagcag | agc | ..gacagggg | .. tcgg .....cagcccagcattt | | 2160 | C A S R A T G G R Q P Q H F |
| 06.027 | TRBV06-5*01 | TRBJ2-3*01 | TRBD1*01 | 465 | tgtgccagcag | ag | ...agggggg | .gccaaccgctc | .....gatacgcagtattt | 2161 | C A S R E G G Q P L D I Q Y F |
| 06.028 | TRBV06-5*01 | TRBJ1-2*01 | TRBD1*01 | 466 | tgtgccagcag | | | ...gggc g gaat | ....ctatggctacacctc | 2162 | C A S R G G I Y G Y T F |
| 06.029 | TRBV06-6*01 | TRBJ2-5*01 | | 467 | tgtgccagcag | act | ...agagaccagtacttc | | | 2163 | C A S R L E T Q Y F |
| 06.030 | TRBV06-3*01 | TRBJ2-1*01 | TRBD2*01 | 468 | tgtgccagcag | att | ...actagc | ......tggtacaatgac | ...........cagttcttc | 2164 | C A S R L L A G Y N D Q F F |
| 06.031 | TRBV06-1*01 | TRBJ2-3*01 | TRBD2*02 | 469 | tgtgccagcag | ..... | acccgacga | ......gagg | ....gatacgcagtatttt | 2165 | C A S R P D E R D T Q Y F |
| 06.032 | TRBV06-5*01 | TRBJ1-4*01 | TRBD1*01 | 470 | tgtgccagcag | ac | ...cagggg | ....cccccttg | ......aacattoagtacttc | 2166 | C A S R P G A P L N I Q Y F |
| 06.033 | TRBV06-1*01 | TRBJ2-1*01 | TRBD2*02 | 471 | tgtgccagcag | acaagcgt | ..tagccgagggg c | ttaccg | ........atgagcagttcttc | 2167 | C A S R Q A L A G G L T D E Q F F |
| 06.034 | TRBV06-1*01 | TRBJ2-1*01 | TRBD2*02 | 472 | tgtgccagcag | c | | .....ggaggg acc | ..cctacaatgagcagttcttc | 2168 | C A S R R D P Y N E Q F F |

Figure 1-18

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.035 | TRBV06-1*01 | TRBJ2-2*01 | TRBD2*02 | 473 | tgtgccagcag | gatgatc | gaggg | caccgggagctgttttt | | 2169 | C A S R R I E G T G E L F F |
| 06.036 | TRBV06-1*01 | TRBJ2-7*01 | TRBD2*02 | 474 | tgtgc | aagcaggtc | gaggg c g | tcctacagcagtacttc | | 2170 | C A S R S R A S Y E Q Y F |
| 06.037 | TRBV06-6*01 | TRBJ2-1*01 | TRBD2*02 | 475 | tgtgccagcag | gagt | actacggagg | ctcctacaatgagcagttcttc | | 2171 | C A S R S T S G G S S Y N E Q F F |
| 06.038 | TRBV06-3*01 | TRBJ2-3*01 | TRBD1*01 | 476 | tgtgccagcag | aaccct c gggacaggg | t | cagatacgcagtattt | | 2172 | C A S R T L G T G S D T Q Y F |
| 06.039 | TRBV06-6*01 | TRBJ2-3*01 | TRBD2*01 | 477 | tgtgccagcag | agttaagaga ggactagc | aga | agatacgcagtattt | | 2173 | C A S R V K R G L A E D T Q Y F |
| 06.040 | TRBV06-1*01 | TRBJ1-2*01 | TRBD1*01 | 478 | tgtgccagcag | ggtaaacc | gggc tgag | tatgctacacctc | | 2174 | C A S R V N R A E Y G Y T F |
| 06.041 | TRBV06-1*01 | TRBJ2-7*01 | TRBD1*01 | 479 | tgtgccagc | tcagc ggacaggg | aa | tacgagcagtacttc | | 2175 | C A S S A D R E Y E Q Y F |
| 06.042 | TRBV06-1*01 | TRBJ2-1*01 | TRBD2*02 | 480 | tgtgccagcagtg | ccctcga | gagg | tacaatgagcagttcttc | | 2176 | C A S S A L E R Y N E Q F F |
| 06.043 | TRBV06-1*01 | TRBJ2-7*01 | TRBD1*01 | 481 | tgtgccagcagtg | c | caggg | acgagcagtacttc | | 2177 | C A S S A R D E Q Y F |
| 06.044 | TRBV06-1*01 | TRBJ2-7*01 | TRBD1*01 | 482 | tgtgccagcagtg | ccc gggac | ggag | cctacgagcagtacttc | | 2178 | C A S S A R D G A Y E Q Y F |
| 06.045 | TRBV06-5*01 | TRBJ2-3*01 | TRBD2*01 | 483 | tgtgccagcagtt | gca | cgggg | cthagagatacc | cagtatttt | 2179 | C A S S C T G L R D T Q Y F |
| 06.046 | TRBV06-5*01 | TRBJ2-7*01 | TRBD2*01 | 484 | tgtgccagcagt | gac | gcgg | aaagcgcgaccagcac | tacttc | 2180 | C A S S D A E S A D Q H Y F |
| 06.047 | TRBV06-1*01 | TRBJ2-7*01 | TRBD1*01 | 485 | tgtgccagcagtga | cga ggacag | cgccgaccagcac | | tacttc | 2181 | C A S S D E D S A D Q H Y F |
| 06.048 | TRBV06-1*01 | TRBJ2-7*01 | TRBD2*01 | 486 | tgtgccagcagtga | cgaggga | agcg | ccgaccagcagtacttt | | 2182 | C A S S D E E S A D Q Q Y F |
| 06.049 | TRBV06-1*01 | TRBJ2-6*01 | TRBD2*01 | 487 | tgtgccagcagtga | ttt | cgggga | a | ggggccaacgtcctgacttc | 2183 | C A S S D F G G G A N V L T F |
| 06.050 | TRBV06-1*01 | TRBJ2-7*01 | TRBD1*01 | 488 | tgtgccagcagtga | cg gggacagg | acctaccac | | cagtacttc | 2184 | C A S S D G D R T Y H Q Y F |
| 06.051 | TRBV06-1*01 | TRBJ2-1*01 | TRBD2*02 | 489 | tgtgccagcagtga | t | ggaggg tggggg | tcctacaatgagcagttcttc | | 2185 | C A S S D G G W G S Y N E Q F F |
| 06.052 | TRBV06-1*01 | TRBJ1-4*01 | | 490 | tgtgccagcagt | cctctt | | tgaaaaactgtttt | | 2186 | C A S S D L F E K L F F |
| 06.053 | TRBV06-6*01 | TRBJ2-4*01 | TRBD1*01 | 491 | tgtgccagcag | cgacccccccg | caggg | ttcg | acattcagtacttc | 2187 | C A S S D P P A G F D I Q Y F |
| 06.054 | TRBV06-1*01 | TRBJ2-6*01 | TRBD2*01 | 492 | tgtgccagcagtga | caggg | ccctat ctctgggggccaacgtcctgacttc | | | 2188 | C A S S D R G P I S G A N V L T F |
| 06.055 | TRBV06-1*01 | TRBJ2-1*01 | TRBD2*01 | 493 | tgtgccagcagtga | tacg | c | caatgagcagttcttc | | 2189 | C A S S D S A N E Q F F |
| 06.056 | TRBV06-1*01 | TRBJ2-2*01 | TRBD2*01 | 494 | tgtgccagcagtga | ct | ctagc | cca | aacaccgggagctgttttt | 2190 | C A S S D S S P N T G E L F F |
| 06.057 | TRBV06-1*01 | TRBJ1-1*01 | TRBD2*01 | 495 | tgtgccagcagtga | t | acag | agaacactgaaga | ttcttt | 2191 | C A S S D T E N T E D F F |
| 06.058 | TRBV06-1*01 | TRBJ2-7*01 | TRBD1*01 | 496 | tgtgccagcagtga | ggctg | aggggc t | tcctacgagcagt | | 2192 | C A S S E A E G A S Y E Q Y F |
| 06.059 | TRBV06-1*01 | TRBJ1-5*01 | TRBD1*01 | 497 | tgtgccagcagtgaagc | cttcggtggtgccct ggga | | | cagcccccagcatttt | 2193 | C A S S E A F G G A L G Q P Q H F |
| 06.060 | TRBV06-1*01 | TRBJ2-2*01 | TRBD1*01 | 498 | tgtgccagcagtgaagc | gggc gt | | ggagctgttttt | | 2194 | C A S S E A G V E L F F |
| 06.061 | TRBV06-1*01 | TRBJ2-3*01 | TRBD1*01 | 499 | tgtgccagcagtgaagc g | cagggg gccc | cacagatacgcagtattt | | | 2195 | C A S S E A Q G G P T D T Q Y F |
| 06.062 | TRBV06-1*01 | TRBJ2-3*01 | TRBD1*01 | 500 | tgtgccagcagtgaagc g | cagggg | gccgcaccacggcgatacgcagtt | | ttt | 2196 | C A S S E A Q G G R T D T Q F F |

Figure 1-19

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.063 | TRBV06-1*01 | TRBJ1-2*01 | TRBD1*01 | 501 | tgtgccagcagtgaagc | cc | gggac... | cgtctgcgt | ...ctatgctacacttc | 2197 | C A S S E A R D R L A V Y G Y T F |
| 06.064 | TRBV06-1*01 | TRBJ2-7*01 | TRBD2*02 | 502 | tgtgccagcagtgaagc | ... | tagcgggag. | ctcctacgagcagtacttc | | 2198 | C A S S E A S G S S Y E Q Y F |
| 06.065 | TRBV06-6*01 | TRBJ2-7*01 | TRBD2*01 | 503 | tgtgccagcagt... | gaagatcc | ccc gggactagcgg | c | ...cgagcagtacttc | 2199 | C A S S E D P P G L A A E Q Y F |
| 06.066 | TRBV06-1*01 | TRBJ2-1*01 | TRBD2*01 | 504 | tgtgccagcagtgaag. | atagt | ...ctagcgggg... | caga... | acaatgagcagttcttc | 2200 | C A S S E D S L A G Q N N E Q F F |
| 06.067 | TRBV06-1*01 | TRBJ2-7*01 | TRBD1*01 | 505 | tgtgccagcagtgaag. | ata cc | gggacagg... | a | .tcctacgagcagtactc | 2201 | C A S S E D T G T G S Y E Q Y F |
| 06.068 | TRBV06-1*01 | TRBJ2-7*01 | TRBD1*01 | 506 | tgtgccagcagtgaag. | aga | gggacagggggc | aggacgagtac | ...........tacttc | 2202 | C A S S E E R D R G Q D E Y Y F |
| 06.069 | TRBV06-1*01 | TRBJ2-6*01 | TRBD2*02 | 507 | tgtgccagcagtgaag. | ......... | agg. | tcaacc | .ctggggccaacgtcctgacttc | 2203 | C A S S E E V N P G A N V L T F |
| 06.070 | TRBV06-1*01 | TRBJ1-2*01 | TRBD2*01 | 508 | tgtgccagcagtgaa.. | tttcgt | ...cggggg. | caagc | ......atgctacacttc | 2204 | C A S S E F S S G G K H G Y T F |
| 06.071 | TRBV06-1*01 | TRBJ2-6*01 | TRBD1*01 | 509 | tgtgccagcagtgaag. | ga | .gacag... | ctctgggccaacgtcctgacttc | | 2205 | C A S S E G D S S G A N V L T F |
| 06.072 | TRBV06-1*01 | TRBJ2-7*01 | TRBD1*01 | 510 | tgtgccagcagtga... | gg | gggacag... | cc | ..cctacgagcagtacttc | 2206 | C A S S E G D S P Y E Q Y F |
| 06.073 | TRBV06-1*01 | TRBJ2-4*01 | TRBD2*01 | 511 | tgtgccagcagtga... | ......... | gggggg | gctagtcaagtgtcgggt | ...caaaacattcagtacttc | 2207 | C A S S E G G A S Q V S G V K N I Q Y F |
| 06.074 | TRBV06-1*01 | TRBJ2-5*01 | TRBD1*01 | 512 | tgtgccagcagtgaag. | gg | ...cagg... | tgtc | .ccaagagaccagtacttc | 2208 | C A S S E G Q V S Q E T Q Y F |
| 06.075 | TRBV06-1*01 | TRBJ2-3*01 | TRBD2*02 | 513 | tgtgccagcagtgaa.. | ......... | ctagcgggag... | a | .cacagatacgcagtatttt | 2209 | C A S S E L A G D T D T Q Y F |
| 06.076 | TRBV06-1*01 | TRBJ2-5*01 | TRBD2*02 | 514 | tgtgccagcagtgaa.. | ......... | ctagcgggaggg | cc | .ccaagagaccagtcagc | 2210 | C A S S E L A G G P Q E T Q Y F |
| 06.077 | TRBV06-1*01 | TRBJ2-6*01 | TRBD2*01 | 515 | tgtgccagcagtgaa.. | ......... | ctag... | gacgctt | ctctgggccaacgtcctgacttc | 2211 | C A S S E L G R F S G A N V L T F |
| 06.078 | TRBV06-1*01 | TRBJ2-5*01 | TRBD2*02 | 516 | tgtgccagcagtgaa.. | cgggcc | ...ggagg. | atcg | ....gagaccagtacttc | 2212 | C A S S E R A G G S E T Q Y F |
| 06.079 | TRBV06-1*01 | TRBJ1-5*01 | TRBD1*01 | 517 | tgtgccagcagtga.. | gcg | ...aggg... | cc | ...caatcagcccagcattt | 2213 | C A S S E R G P N Q P Q H F |
| 06.080 | TRBV06-1*01 | TRBJ1-1*01 | TRBD1*01 | 518 | tgtgccagcagtgaa.. | a | .ggacagg... | tgg | .gaacactgaagcttcttt | 2214 | C A S S E R T G G N T E A F F |
| 06.081 | TRBV06-1*01 | TRBJ1-1*01 | TRBD1*01 | 519 | tgtgccagcagtgaa.. | ......... | acag... | ac | .aacactgaagcttcttt | 2215 | C A S S E T D N T E A F F |
| 06.082 | TRBV06-1*01 | TRBJ2-7*01 | TRBD1*01 | 520 | tgtgccagcagtgaa.. | ac. | ggacaggg... | tc | ...acgagcagtacttc | 2216 | C A S S E T D R G H E Q Y F |
| 06.083 | TRBV06-1*01 | TRBJ2-7*01 | TRBD2*02 | 521 | tgtgccagcagtga... | ga | ...cgggaggg | tatgg | .....cgagcagtacttc | 2217 | C A S S E T G G Y G E Q Y F |
| 06.084 | TRBV06-1*01 | TRBJ2-7*01 | | 522 | tgtgccagcagtga... | gaccat | ctcctacgagcagtactt | | | 2218 | C A S S E T I S Y E Q Y F |
| 06.085 | TRBV06-1*01 | TRBJ2-1*01 | TRBD2*02 | 523 | tgtgccagcagtga... | gactagcgggaggg | agactgac | ............ttcttc | | 2219 | C A S S E T S G R E T D F F |
| 06.086 | TRBV06-1*01 | TRBJ1-3*01 | TRBD2*01 | 524 | tgtgccagcagtgaag. | tat | ...cggg. | tag | ...tggaaacaccatatattt | 2220 | C A S S E V S G G N T I Y F |
| 06.087 | TRBV06-6*01 | TRBJ2-5*01 | TRBD1*01 | 525 | tgtgccagcag...... | cttcta | ..acag... | actt | .ccaagagaccagtacttc | 2221 | C A S S F L T D F Q E T Q Y F |
| 06.088 | TRBV06-3*01 | TRBJ2-7*01 | | 526 | tgtgccagcagtt... | ttcccgtgtagt | .....agagaccagtacttc | | | 2222 | C A S S F P G V V E T Q Y F |
| 06.089 | TRBV06-5*01 | TRBJ2-7*01 | TRBD2*02 | 527 | tgtgccagcagt..... | gggg | ......agcgggaggg | gagg | ....tacgagcagtacttc | 2223 | C A S S G E R E G R Y E Q Y F |

Figure 1-20

| clone # | V name | J name | D name | SEQ ID NO: | V-REGION | N1 | D-REGION | (P) | N2 | J-REGION | SEQ ID NO: | CDR3 amino acid |
|---|---|---|---|---|---|---|---|---|---|---|---|---|
| 06.090 | TRBV06-1*01 | TRBJ2-1*01 | TRBD2*01 | 528 | tgtgccagcagtg | gactagcgg | at | | tacaatgagcagttcttc | | 2224 | C A S S G L A D Y N E Q F F |
| 06.091 | TRBV06-6*01 | TRBJ1-1*01 | TRBD1*01 | 529 | tgtgccagcagt | ggacag | ccca | | tgaacactgaagcttcttt | | 2225 | C A S S G Q P M N T E A F F |
| 06.092 | TRBV06-6*01 | TRBJ2-7*01 | TRBD1*01 | 530 | tgtgccagcagt | gg cc gggaca | cagctg | | cctacgagcagtactc | | 2226 | C A S S G R D T A A Y E Q Y F |
| 06.093 | TRBV06-1*01 | TRBJ1-1*01 | TRBD1*01 | 531 | tgtgccagcagtg | gt acag | a | | gaacactgaagcttctt | | 2227 | C A S S G T E N T E A F F |
| 06.094 | TRBV06-1*01 | TRBJ2-3*01 | TRBD2*02 | 532 | tgtgccagcag | ccacgctcat | gaggg agcg | | gatacgcagtattt | | 2228 | C A S S H A H E G A D T Q Y F |
| 06.095 | TRBV06-5*01 | TRBJ2-3*01 | TRBD2*01 | 533 | tgtgccagcagt | cacctcg gggac | gga | | acagatacgcagtatttt | | 2229 | C A S S H L G D T D T Q Y F |
| 06.096 | TRBV06-5*01 | TRBJ1-2*01 | | 534 | tgtgccagcagt | ccataacc | ctaactatgctacacctc | | | | 2230 | C A S S H N P N Y G Y T F |
| 06.097 | TRBV06-6*04 | TRBJ1-1*01 | TRBD1*01 | 535 | tgtgccagcagc | ccacc | ggggtc | | ggggggaccccacacttcggtttt | ttt | 2231 | C A S S H R G R G D P H T F G F F |
| 06.098 | TRBV06-5*01 | TRBJ2-2*01 | TRBD2*01 | 536 | tgtgccagcagt | cactcaagg | agcgggg | | accatttatc | cttc | 2232 | C A S S H S R S G D H L S F |
| 06.099 | TRBV06-2*01 | TRBJ2-2*01 | TRBD2*01 | 537 | tgtgccagcagt | att gact | ctcaag | | ccggggagctgttttt | | 2233 | C A S S I D S Q A G E L F F |
| 06.100 | TRBV06-5*01 | TRBJ2-7*01 | TRBD2*02 | 538 | tgtgccagcag | cat tagcgggag | cca ctcctacgagcagtactc | | | | 2234 | C A S S I S G S H S Y E Q Y F |
| 06.101 | TRBV06-5*01 | TRBJ2-7*01 | TRBD1*01 | 539 | tgtgccagcagt | atctcaaggatcg | gggaca | atct | | gtactc | 2235 | C A S S I S R I G D N L Y F |
| 06.102 | TRBV06-5*01 | TRBJ2-7*01 | TRBD1*01 | 540 | tgtgccagcagt | atctcaaggaccg | gggaca | atct | | gtactc | 2236 | C A S S I S R T G D N L Y F |
| 06.103 | TRBV06-6*01 | TRBJ2-7*01 | TRBD1*01 | 541 | tgtgccagcagt | a | agggggc agggggccgcctac | | ggctacaccttc | | 2237 | C A S S K G A G A A Y G Y T F |
| 06.104 | TRBV06-5*01 | TRBJ1-3*01 | TRBD2*01 | 542 | tgtgccagcagt | aaataccct | ggggc a | | gaaacaccatatatttt | | 2238 | C A S S K Y P G G R N T I Y F |
| 06.105 | TRBV06-6*01 | TRBJ2-7*01 | TRBD2*02 | 543 | tgtgccagcag | c | ctagcgggag tt | | tacgagcagtactc | | 2239 | C A S S L A G V Y E Q Y F |
| 06.106 | TRBV06-5*01 | TRBJ2-1*01 | TRBD2*01 | 544 | tgtgccagcagtt | t gggactagcgggg | a | | acaatgagcagttctc | | 2240 | C A S S L G L A G N N E Q F F |
| 06.107 | TRBV06-5*01 | TRBJ1-3*01 | TRBD1*01 | 545 | tgtgccagcagt | t gggacagggggc | | | aaacaccatatattt | | 2241 | C A S S L G Q G A N T I Y F |
| 06.108 | TRBV06-6*01 | TRBJ2-5*01 | TRBD1*01 | 546 | tgtgccagcag | cct gggacag | c | | accaagagaccagtactc | | 2242 | C A S S L G Q H Q E T Q Y F |
| 06.109 | TRBV06-5*01 | TRBJ2-1*01 | TRBD2*01 | 547 | tgtgccagcagt | ct c gggact | cccgg | | atgagcagttctc | | 2243 | C A S S L G T P R D E Q F F |
| 06.110 | TRBV06-3*01 | TRBJ1-2*01 | TRBD1*01 | 548 | tgtgccagcagtt | taatcc gacaggg | ttgggg | | ctatgctacacctc | | 2244 | C A S S L I R Q G W G Y G Y T F |
| 06.111 | TRBV06-1*01 | TRBJ2-1*01 | TRBD2*02 | 549 | tgtgccagcagt | ttg ctagcggag | aaaacg | | acgagcagtactc | | 2245 | C A S S L L A G E N D E Q Y F |
| 06.112 | TRBV06-9*01 | TRBJ1-5*01 | TRBD1*01 | 550 | tgtgccagcagt | ct cagg | a | | cccagcattt | | 2246 | C A S S L R T Q H F |
| 06.113 | TRBV06-5*01 | TRBJ1-1*01 | TRBD1*01 | 551 | tgtgccagcagt | ctctccggaccg | gggaca | atctgtc | | cttc | 2247 | C A S S L S G T G D N L S F |
| 06.114 | TRBV06-5*01 | TRBJ2-1*01 | TRBD2*01 | 552 | tgtgccagcagt | cta | ag ctcctacaatgagcagttcttc | | | | 2248 | C A S S L S S Y N E Q F F |
| 06.115 | TRBV06-3*01 | TRBJ1-5*01 | TRBD1*01 | 553 | tgtgccagcgc | tcca acaggggc cg | aatcagcccagcattt | | | | 2249 | C A S S N R G P N Q P Q H F |
| 06.116 | TRBV06-3*01 | TRBJ2-7*01 | TRBD2*02 | 554 | tgtgccagcagt | cc | agcgggag agggg | | tacgagcagtactc | | 2250 | C A S S P A G E G Y E Q Y F |

Figure 1-21

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.117 | TRBV06-5*01 | TRBJ2-5*01 | TRBD1*01 | 555 | tgtgccagcagt | cca..gacag...agc | agagaccagtactc | | | 2251 | C A S S P D R A E T Q Y F |
| 06.118 | TRBV06-5*01 | TRBJ1-3*01 | TRBD1*01 | 556 | tgtgccagcag | ccc..gga | gtccgtccgagga | ggaaaacaccatatttt | | 2252 | C A S S P E S V R G G N T I Y F |
| 06.119 | TRBV06-5*01 | TRBJ2-6*01 | | 557 | tgtgccagcagt | c..ctgggcaacgtcctgacttc | | | | 2253 | C A S S P G A N V L T F |
| 06.120 | TRBV06-5*01 | TRBJ2-7*01 | TRBD2*01 | 558 | tgtgccagcagt | cc | cgggggg gggacgactat | | cagtacttc | 2254 | C A S S P G G G D D Y Q Y F |
| 06.121 | TRBV06-5*01 | TRBJ1-4*01 | TRBD2*01 | 559 | tgtgccagcag | ccc | cgggggg g | aaaactgttttt | | 2255 | C A S S P G G G K L F F |
| 06.122 | TRBV06-5*01 | TRBJ2-7*01 | TRBD2*01 | 560 | tgtgccagcagt | cc | cgggggg ggaacgaccac | | cagtacttc | 2256 | C A S S P G G G N D H Q Y F |
| 06.123 | TRBV06-5*01 | TRBJ2-7*01 | TRBD2*01 | 561 | tgtgccagcagt | cc | cgggggg ggaactacc | | agcagtacttc | 2257 | C A S S P G G G N Y Q Q Y F |
| 06.124 | TRBV06-5*01 | TRBJ2-1*01 | TRBD2*01 | 562 | tgtgccagcag | ccccgggc | cgggg..ccggg | | aatgagcagttcttc | 2258 | C A S S P G P G P G N E Q F F |
| 06.125 | TRBV06-6*01 | TRBJ2-1*01 | TRBD1*01 | 563 | tgtgccagcagt | cc gggacagggg | ggat | caatgagcagttcttc | | 2259 | C A S S P G Q G G I N E Q F F |
| 06.126 | TRBV06-5*01 | TRBJ2-7*01 | TRBD1*01 | 564 | tgtgccagcagt | cc gggacaggg | caa | ctacgagcagttctc | | 2260 | C A S S P G Q G N Y E Q Y F |
| 06.127 | TRBV06-5*01 | TRBJ2-7*01 | TRBD1*01 | 565 | tgtgccagcagt | cc gggacaggg | caactaca | agcagtacttc | | 2261 | C A S S P G Q G N Y K Q Y F |
| 06.128 | TRBV06-6*01 | TRBJ2-1*01 | TRBD1*01 | 566 | tgtgccagcagt | cca gggacagg | at | ctacaatgagcagttctc | | 2262 | C A S S P G T G I Y N E Q F F |
| 06.129 | TRBV06-5*01 | TRBJ2-3*01 | TRBD2*02 | 567 | tgtgccagcagt | ccaa | tagcaggaggg cc tggg | gatacgcagtattt | | 2263 | C A S S P I A G G P G D T Q Y F |
| 06.130 | TRBV06-6*01 | TRBJ2-5*01 | TRBD1*01 | 568 | tgtgccagcag | ccogatta | acagggggc accaagagaccagtacttc | | | 2264 | C A S S P I N R G H Q E T Q Y F |
| 06.131 | TRBV06-2*01 | TRBJ1-4*01 | TRBD1*01 | 569 | tgtgccagcagt | cccaaggcggcg ggga | tc | aatgaaaactgttttt | | 2265 | C A S S P K A A G I N E K L F F |
| 06.132 | TRBV06-6*01 | TRBJ2-3*01 | TRBD2*01 | 570 | tgtgccagcagt | ccc | actagcg | aaccg | acagatacgcagtatttt | 2266 | C A S S P L A E P T D T Q Y F |
| 06.133 | TRBV06-3*01 | TRBJ2-3*01 | TRBD2*02 | 571 | tgtgccagcagt | ccctg | agcggagg cacgcg | gatacgcagtatttt | | 2267 | C A S S P L S G R H A D T Q Y F |
| 06.134 | TRBV06-6*01 | TRBJ2-3*01 | TRBD1*01 | 572 | tgtgccagcagt | cct cc gggac | ctaagat | agatacgcagtatttt | | 2268 | C A S S P P G P K I D T Q Y F |
| 06.135 | TRBV06-5*01 | TRBJ1-5*01 | TRBD1*01 | 573 | tgtgccagcagt | ccct | cagggctcctcgc | gccccagccatttt | | 2269 | C A S S P S G L L A P Q H F |
| 06.136 | TRBV06-5*01 | TRBJ2-7*01 | TRBD1*01 | 574 | tgtgccagcag | ccccctc | gacaggg | agtctggg | cgagcagtacttc | 2270 | C A S S P S T G S L G E Q Y F |
| 06.137 | TRBV06-5*01 | TRBJ2-3*01 | TRBD1*01 | 575 | tgtgccagcagt | ccta cc gggacaggggg | cggga | gagcagtacttc | | 2271 | C A S S P T G T G A G E Q Y F |
| 06.138 | TRBV06-6*01 | TRBJ2-3*01 | TRBD2*01 | 576 | tgtgccagcag | caa ggacaggggg | aggttg | acagatacgcagtatttt | | 2272 | C A S S Q G Q G R L T D T Q Y F |
| 06.139 | TRBV06-2*01 | TRBJ1-2*01 | TRBD1*01 | 577 | tgtgccagcag | ccaaaaaccccggccct | ggga | agtggag | accttc | 2273 | C A S S Q K P G P W E V E T F |
| 06.140 | TRBV06-1*01 | TRBJ2-1*01 | TRBD2*01 | 578 | tgtgccagcag | ccgattga gggact | ctacaatgagcagttcttc | | | 2274 | C A S S R L E G L Y N E Q F F |
| 06.141 | TRBV06-6*01 | TRBJ2-7*01 | TRBD2*01 | 579 | tgtgccagcag | cc ggactag | tatcc | atgagcagttcttc | | 2275 | C A S S R T S I H E Q F F |
| 06.142 | TRBV06-2*01 | TRBJ2-1*01 | TRBD2*01 | 580 | tgtgccagcag | ccgt actag | tgtgaggccc | tcttc | | 2276 | C A S S R T S V R A L F |
| 06.143 | TRBV06-1*01 | TRBJ2-7*01 | | 581 | tgtgccagcag | ctccgcatgg | gagcagtacttc | | | 2277 | C A S S S A W E Q Y F |
| 06.144 | TRBV06-5*01 | TRBJ2-7*01 | TRBD2*01 | 582 | tgtgccagcagtt | ccgaa | cggg | ccaggtgcaacaa | tacttc | 2278 | C A S S S E R A R C Q Q Y F |

Figure 1-22

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.145 | TRBV06-5*01 | TRBJ2-7*01 | TRBD2*01 | 583 | tgtgccagcagtt... | c | .......cgggg... | caa | ..cctacgagcagtactto | 2279 | C A S S S G A T Y E Q Y F |
| 06.146 | TRBV06-5*01 | TRBJ2-7*01 | TRBD2*01 | 584 | tgtgccagcagtt... | c | ......cgggggg... | aa | ..cctacgagcagtactto | 2280 | C A S S S G G T Y E Q Y F |
| 06.147 | TRBV06-5*01 | TRBJ1-1*01 | TRBD1*01 | 585 | tgtgccagcagtt... | ca | ..ggaca..... | ca | tgaacactgaagcttcttt | 2281 | C A S S S G H M N T E A F F |
| 06.148 | TRBV06-2*01 | TRBJ2-1*01 | TRBD2*01 | 586 | tgtgccagcagtt... | c | gggactag..... | gttt | ......caatgagcagttcttc | 2282 | C A S S S G L G F N E Q F F |
| 06.149 | TRBV06-6*01 | TRBJ2-1*01 | TRBD1*01 | 587 | tgtgccagcag..... | ctca ..ggacaggg... | aggatcctacaatgat | ........cagttcttc | | 2283 | C A S S S G Q G G S Y N D Q F F |
| 06.150 | TRBV06-6*01 | TRBJ2-5*01 | TRBD1*01 | 588 | tgtgccagcag..... | ct cc gggacaggg... | cggg | ..agagaccagtactto | | 2284 | C A S S S G T G A G E T Q Y F |
| 06.151 | TRBV06-5*01 | TRBJ2-1*01 | TRBD2*02 | 589 | tgtgccagcagtt... | cc gggactacgcggg... | attttt | ..tacaatgagcagttcttc | | 2285 | C A S S S G T S G D F Y N E Q F F |
| 06.152 | TRBV06-5*01 | TRBJ2-3*01 | | 590 | tgtgccagcagtt... | ccctccctctg ..cagatacgcagtattt | | | | 2286 | C A S S S L P L A D T Q Y F |
| 06.153 | TRBV06-5*01 | TRBJ2-7*01 | TRBD2*02 | 591 | tgtgccagcagtt... | ctctct cc gggactagcggga... | aaacaggg ...tacgagcagtactto | | | 2287 | C A S S S L S G T S G K T G Y E Q Y F |
| 06.154 | TRBV06-5*01 | TRBJ1-3*01 | | 592 | tgtgccagcagtt... | cctcggtgaa ..tgaaacaccatatattt | | | | 2288 | C A S S S V N G N T I Y F |
| 06.155 | TRBV06-5*01 | TRBJ1-1*01 | TRBD1*01 | 593 | tgtgccagcag..... | ctca ..acaggg... | ..acactgaagcttcttt | | | 2289 | C A S S S T G D T E A F F |
| 06.156 | TRBV06-1*01 | TRBJ2-3*01 | TRBD1*01 | 594 | tgtgccagcagt.... | ..acaggg... | ttccg | ...agatacgcagtattt | | 2290 | C A S S T G F R D T Q Y F |
| 06.157 | TRBV06-5*01 | TRBJ1-2*01 | TRBD1*01 | 595 | tgtgccagcagt.... | act ..acaggggg... | aaag | ...ggctacacctto | | 2291 | C A S S T T G G K G Y T F |
| 06.158 | TRBV06-1*01 | TRBJ2-1*01 | TRBD1*01 | 596 | tgtgccagcagtg... | tcaa .........gggc tagttagggag... | tacaatgagcagttcttc | | | 2292 | C A S S V K G L V R E Y N E Q F F |
| 06.159 | TRBV06-5*01 | TRBJ2-5*01 | TRBD2*02 | 597 | tgtgccagcagt.... | gtcc gggactagcgga... | ........gagcagttcttc | | | 2293 | C A S S V P G L A G E Q F F |
| 06.160 | TRBV06-6*01 | TRBJ2-1*01 | TRBD1*01 | 598 | tgtgccagcagt.... | gt ..aca..... | aaa ctctacaatgagcagttcttc | | | 2294 | C A S S V Q N S Y N E Q F F |
| 06.161 | TRBV06-6*01 | TRBJ1-1*01 | TRBD1*01 | 599 | tgtgccagcagtg... | tga ggga......... | gaacactgaagcttcttt | | | 2295 | C A S S V R E N T E A F F |
| 06.162 | TRBV06-3*01 | TRBJ2-1*01 | TRBD2*01 | 600 | tgtgccagcagtt... | ggg cc gggacta........ | cg | ......aatgagcagttcttc | | 2296 | C A S S W A G T T N E Q F F |
| 06.163 | TRBV06-3*01 | TRBJ2-5*01 | TRBD1*01 | 601 | tgtgccagcagtt... | ........ggggg. atggg ...agagaccagtactto | | | | 2297 | C A S S W G M G E T Q Y F |
| 06.164 | TRBV06-5*01 | TRBJ2-7*01 | TRBD2*01 | 602 | tgtgccagcagtt... | gga ..ggactagcgg..... | t | ...tacgagcagtactto | | 2298 | C A S S W R T S G Y E Q Y F |
| 06.165 | TRBV06-6*01 | TRBJ2-3*01 | TRBD1*01 | 603 | tgtgccagcagtt... | ggacaggg... | ct ..acagatacgcagtattt | | | 2299 | C A S S W T G L T D T Q Y F |
| 06.166 | TRBV06-3*01 | TRBJ1-5*01 | TRBD1*01 | 604 | tgtgccagcagttac... | gcc ..gacaggg... | aagta | ......cagcccccagcatttt | | 2300 | C A S S Y A D R E V Q P Q H F |
| 06.167 | TRBV06-3*01 | TRBJ2-1*01 | TRBD1*01 | 605 | tgtgccagcagttac... | gc ..ggaca...... | ctttt ctcctacaatgagcagttcttc | | | 2301 | C A S S Y A D T F S Y N E Q F F |
| 06.168 | TRBV06-3*01 | TRBJ2-1*01 | TRBD1*01 | 606 | tgtgccagcagttac... | g ..caggg... | c | ........tgagcagttcttc | | 2302 | C A S S Y A G A E Q F F |
| 06.169 | TRBV06-5*01 | TRBJ1-6*01 | TRBD1*01 | 607 | tgtgccagcagttac... | gc ..gacaggggg... | agggg | ........tcaccctccactttt | | 2303 | C A S S Y A T G E G S P L H F |
| 06.170 | TRBV06-6*01 | TRBJ1-4*01 | TRBD1*01 | 608 | tgtgccagcagttac... | gcct... .acaggg... | aga caactaatgaaaaactgttttt | | | 2304 | C A S S Y A Y R E T T N E K L F F |
| 06.171 | TRBV06-6*01 | TRBJ2-5*01 | | 609 | tgtgccagcagtact... | ttgagatg ..aagagaccagtactto | | | | 2305 | C A S S Y F E M E E T Q Y F |
| 06.172 | TRBV06-5*01 | TRBJ1-1*01 | | 610 | tgtgccagcagtta... | tttcc tgaacactgaagcttcttt | | | | 2306 | C A S S Y F L N T E A F F |

Figure 1-23

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.173 | TRBV06-3*01 | TRBJ2-5*01 | TRBD2*02 | 611 | tgtgccagcagttact. | tctccccc. | ggactagcgggag. | ...aagagacccagtactic | | 2307 | C A S S Y F S P G L A G E E T Q Y F |
| 06.174 | TRBV06-5*01 | TRBJ2-7*01 | TRBD2*01 | 612 | tgtgccagcagttac. | ggg | ...gcggggggg. | a | ...tacgagcagtactic | 2308 | C A S S Y G A G G G Y E Q Y F |
| 06.175 | TRBV06-5*01 | TRBJ2-1*01 | TRBD1*01 | 613 | tgtgccagcagttac. | | ...ggggc cccacccag | ... | tacaatgagcagttctc | 2309 | C A S S Y G A P P Q Y N E Q F F |
| 06.176 | TRBV06-2*01 | TRBJ2-3*01 | TRBD2*01 | 614 | tgtgccagcagttac. | gggg | ...ctagcgg. | ... | ttcagatacctac. | ...tatttt | 2310 | C A S S Y G A S G S D T Y Y F |
| 06.177 | TRBV06-5*01 | TRBJ2-7*01 | TRBD2*01 | 615 | tgtgccagcagttac. | g | gggacta. | ... | ctcctacgagcagtactic | 2311 | C A S S Y G D Y S Y E Q Y F |
| 06.178 | TRBV06-1*01 | TRBJ2-7*01 | TRBD2*01 | 616 | tgtgccagcagt. | tacg | gggacta. | ...ctcctacc. | ...agcagtactic | 2312 | C A S S Y G D Y S Y Q Q Y F |
| 06.179 | TRBV06-5*01 | TRBJ2-2*01 | TRBD2*01 | 617 | tgtgccagcagttac. | ggactagcgg. | ...ta. | ..aacaccggggagctgttttt | | 2313 | C A S S Y G L A V N T G E L F F |
| 06.180 | TRBV06-5*01 | TRBJ1-2*01 | TRBD1*01 | 618 | tgtgccagcagttac. | | ...gggc aaacgat. | taactatggctacacctc | | 2314 | C A S S Y G Q T I N Y G Y T F |
| 06.181 | TRBV06-6*01 | TRBJ2-7*01 | TRBD2*02 | 619 | tgtgccagcagttac. | ggccgcgc | ...gcgggag. | ccctatgg | tg. | ...gtacttc | 2315 | C A S S Y G R A R E P L W W Y F |
| 06.182 | TRBV06-5*01 | TRBJ1-2*01 | TRBD1*01 | 620 | tgtgccagcagttac. | gg | ...cagg. | ...ag | taactatggctacacctc | 2316 | C A S S Y G R S N Y G Y T F |
| 06.183 | TRBV06-5*01 | TRBJ2-1*01 | TRBD1*01 | 621 | tgtgccagcagttac. | | ...ggac. | ...gggt | ...caatgagcagtactic | 2317 | C A S S Y G R V N E Q F F |
| 06.184 | TRBV06-5*01 | TRBJ2-7*01 | | 622 | tgtgccagcagttac. | | agcagca | ..cctacgagcagtactic | | 2318 | C A S S Y G S T Y E Q Y F |
| 06.185 | TRBV06-5*01 | TRBJ2-2*01 | TRBD1*01 | 623 | tgtgccagcagttac. | gggacaggg. | aagt | ...caccggggagctgttttt | | 2319 | C A S S Y G T G E V T G E L F F |
| 06.186 | TRBV06-5*01 | TRBJ1-6*01 | TRBD1*01 | 624 | tgtgccagcagttac. | ggt | ...acaggg. | acgattc | ...attcaccctccacttt | 2320 | C A S S Y G T I H S P L H F |
| 06.187 | TRBV06-2*01 | TRBJ2-3*01 | TRBD2*01 | 625 | tgtgccagcagttac. | gggac. | | cagcgcctccatacgcactt. | ...tttt | 2321 | C A S S Y G T S A S H T H F F |
| 06.188 | TRBV06-2*01 | TRBJ2-3*01 | TRBD2*01 | 626 | tgtgccagcagttac. | gggactagcgg. | ...tt | ...cagatacgcagtattt | | 2322 | C A S S Y G T S G S D T Q Y F |
| 06.189 | TRBV06-2*01 | TRBJ2-7*01 | TRBD1*01 | 627 | tgtgccagcagttac. | g | ...gcg. | ...t | ...ctacgagcagtactic | 2323 | C A S S Y G V Y E Q Y F |
| 06.190 | TRBV06-5*01 | TRBJ1-6*01 | TRBD1*01 | 628 | tgtgccagcagttac. | at | ...acag. | | aattcaccctccactt | 2324 | C A S S Y I Q N S P L H F |
| 06.191 | TRBV06-6*01 | TRBJ2-3*01 | TRBD2*02 | 629 | tgtgccagcagtta. | t | ...ctagcggga. | aa | ..cacagatacgcagtatttt | 2325 | C A S S Y L A G N T D T Q Y F |
| 06.192 | TRBV06-5*01 | TRBJ1-1*01 | TRBD1*01 | 630 | tgtgccagcagttac. | ctc | ...gggg. | gtc | gaacactgaagcttcttc | 2326 | C A S S Y L G G S N T E A F F |
| 06.193 | TRBV06-6*01 | TRBJ2-7*01 | TRBD1*01 | 631 | tgtgccagcagttact. | t | gggacagg. | a | ...gagcagtactic | 2327 | C A S S Y L G Q G E Q Y F |
| 06.194 | TRBV06-6*01 | TRBJ2-5*01 | TRBD2*02 | 632 | tgtgccagcagttac. | ctgact | ...ctagcgggaggg | cc | ccaagagacccagtactic | 2328 | C A S S Y L T L A G G P Q E T Q Y F |
| 06.195 | TRBV06-3*01 | TRBJ2-4*01 | TRBD1*01 | 633 | tgtgccagcagttac. | aaccc. | .gaca. | ...tcagg | agccaaaaacattcagtactic | 2329 | C A S S Y N P T S G A K N I Q Y F |
| 06.196 | TRBV06-2*01 | TRBJ2-2*01 | TRBD1*01 | 634 | tgtgccagcagttac. | ccc | ggacaggggc | cc | ..acaccggggagctgttttt | 2330 | C A S S Y P G Q G A H T G E L F F |
| 06.197 | TRBV06-5*01 | TRBJ2-7*01 | TRBD1*01 | 635 | tgtgccagcagttac. | ca | ggacaggg. | | ...tacgagcagtactic | 2331 | C A S S Y Q D R G Y E Q Y F |
| 06.198 | TRBV06-3*01 | TRBJ1-5*01 | TRBD1*01 | 636 | tgtgccagcagttac. | | ...cagggg. | tggggcc | ..caatcagcccagcatttt | 2332 | C A S S Y Q Q G W G P N Q P Q H F |
| 06.199 | TRBV06-5*01 | TRBJ2-1*01 | TRBD2*02 | 637 | tgtgccagcagttac. | | | aggg | ...atgag | 2333 | C A S S Y R D E Q F F |
| 06.200 | TRBV06-5*01 | TRBJ2-7*01 | TRBD2*01 | 638 | tgtgccagcagtta. | ta | gggac. | | ctcccctaccaacaa. | ...tacttc | 2334 | C A S S Y R D L P Y Q Q Y F |

Figure 1-24

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.201 | TRBV06-2*01 | TRBJ2-1*01 | TRBD2*01 | 639 | tgtgccagcagtta... | tc | gggact......cgta | ...ctacaatgagcagttcttc | | 2335 | C A S S Y R D S Y Y N E Q F F |
| 06.202 | TRBV06-5*01 | TRBJ2-7*01 | TRBD2*01 | 640 | tgtgccagcagtta... | ta | gggac............ | gtcg ...cctacgagcagtacttc | | 2336 | C A S S Y R D V A Y E Q Y F |
| 06.203 | TRBV06-5*01 | TRBJ2-7*01 | TRBD2*01 | 641 | tgtgccagcagtta... | ta | gggac............ | gttc ...cctacgagcagtacttc | | 2337 | C A S S Y R D V P Y E Q Y F |
| 06.204 | TRBV06-5*01 | TRBJ2-7*01 | TRBD2*01 | 642 | tgtgccagcagtta... | ta | gggac............ | gtccctaccaa........cagtacttc | | 2338 | C A S S Y R D V P Y Q Q Y F |
| 06.205 | TRBV06-5*01 | TRBJ2-7*01 | TRBD1*01 | 643 | tgtgccagcagttac. | cgt | ggacaggg. | a .....acgagcagtacttc | | 2339 | C A S S Y R G Q G N E Q Y F |
| 06.206 | TRBV06-5*01 | TRBJ2-7*01 | TRBD1*01 | 644 | tgtgccagcagtac. | cgcgg | ...cagg... | ttttgg ...acgagcagtacttc | | 2340 | C A S S Y R G R V L D E Q Y F |
| 06.207 | TRBV06-6*01 | TRBJ1-5*01 | TRBD1*01 | 645 | tgtgccagcagtac. | c ..gaca..... | ag | a tagcaatcagcccagcattc | | 2341 | C A S S Y R Q D S N Q P Q H F |
| 06.208 | TRBV06-5*01 | TRBJ2-7*01 | TRBD1*01 | 646 | tgtgccagcagtac. | c ..gacaggg. | a ...cctacgagcagtacttc | | | 2342 | C A S S Y R Q G T Y E Q Y F |
| 06.209 | TRBV06-6*01 | TRBJ2-7*01 | TRBD2*01 | 647 | tgtgccagcagtta. | cgccaatacacatcc ..gac. | ........gg t | ...tacgagcagtacttc | | 2343 | C A S S Y R Q Y T S D G Y E Q Y F |
| 06.210 | TRBV06-3*01 | TRBJ2-3*01 | TRBD1*01 | 648 | tgtgccagcagttac. | cggt ......gggg. tgtgatacc | ...... | cagtatttt | | 2344 | C A S S Y R W G V D T Q Y F |
| 06.211 | TRBV06-5*01 | TRBJ2-1*01 | TRBD2*01 | 649 | tgtgccagcagtactc | g ......gccggg. | ........ | gagcagttcttc | | 2345 | C A S S Y S A G E Q F F |
| 06.212 | TRBV06-6*01 | TRBJ2-5*01 | TRBD1*01 | 650 | tgtgccagcagtactc | .ggac........... | gagaccagtacttc | | | 2346 | C A S S Y S D E T Q Y F |
| 06.213 | TRBV06-5*01 | TRBJ1-6*01 | TRBD1*01 | 651 | tgtgccagcagtactc | tg gggacag.... | tcaggta ......tcacccctccactt | | | 2347 | C A S S Y S G D S Q V S P L H F |
| 06.214 | TRBV06-5*01 | TRBJ2-1*01 | TRBD2*02 | 652 | tgtgccagcagtactc | gggcggag ......agcgggaggg. ccggg......atgagcagttcttc | | | | 2348 | C A S S Y S G G E R E G R D E Q F F |
| 06.215 | TRBV06-5*01 | TRBJ1-3*01 | TRBD2*02 | 653 | tgtgccagcagtactc | ........gggagg. aaa ..tgaaacaccatatatttt | | | | 2349 | C A S S Y S G G N G N T I Y F |
| 06.216 | TRBV06-5*01 | TRBJ2-7*01 | TRBD1*01 | 654 | tgtgccagcagtactc | t .......gggc ccctt ...tacgagcagtacttc | | | | 2350 | C A S S Y S G P L Y E Q Y F |
| 06.217 | TRBV06-5*01 | TRBJ2-7*01 | TRBD2*02 | 655 | tgtgccagcagtactc | a ........gggaggg gctatgattacto .........cttc | | | | 2351 | C A S S Y S G R G Y D Y S F |
| 06.218 | TRBV06-5*01 | TRBJ2-7*01 | TRBD1*01 | 656 | tgtgccagcagtactc | .......gggc cgacggcccctgg ...acgagcagtacttc | | | | 2352 | C A S S Y S G R R P L D E Q Y F |
| 06.219 | TRBV06-6*01 | TRBJ1-3*01 | TRBD1*01 | 657 | tgtgccagcagtactc | gaagg ...cagggg. gaga ...ggaaaccatatatttt | | | | 2353 | C A S S Y S K A G G R G N T I Y F |
| 06.220 | TRBV06-5*01 | TRBJ1-1*01 | TRBD1*01 | 658 | tgtgccagcagtactc | ctt ....agggg. aag ...cactgaagcttcttt | | | | 2354 | C A S S Y S L G G S T E A F F |
| 06.221 | TRBV06-5*01 | TRBJ2-3*01 | | 659 | tgtgccagcagtactc | g ccaga ..cacagatacgcagtattc | | | | 2355 | C A S S Y S P D T D T Q Y F |
| 06.222 | TRBV06-3*01 | TRBJ2-7*01 | TRBD2*01 | 660 | tgtgccagcagtactc | ccc ..gactacgg.... ccctg ......gagcagtacttc | | | | 2356 | C A S S Y S P T S G P W E Q Y F |
| 06.223 | TRBV06-5*01 | TRBJ2-1*01 | TRBD1*01 | 661 | tgtgccagcagtactc | t ...cagggggg. ag ......aatgagcagttcttc | | | | 2357 | C A S S Y S Q G E N E Q F F |
| 06.224 | TRBV06-6*01 | TRBJ1-2*01 | TRBD1*01 | 662 | tgtgccagcagtactc | t .....cag..... ctag ctaactatgctacacctc | | | | 2358 | C A S S Y S Q L A N Y G Y T F |
| 06.225 | TRBV06-3*01 | TRBJ2-7*01 | TRBD1*01 | 663 | tgtgccagcagtactc | ccaa c gggac....... gatc ...cctacgagcagtacttc | | | | 2359 | C A S S Y S Q R D D P Y E Q Y F |
| 06.226 | TRBV06-6*01 | TRBJ2-1*01 | TRBD1*01 | 664 | tgtgccagcagtactc | gag a ..gacagg.... cc ctcctacaatgagcagttcttc | | | | 2360 | C A S S Y S R D R P S Y N E Q F |
| 06.227 | TRBV06-5*01 | TRBJ2-2*01 | | 665 | tgtgccagcagtactc | tcgtgaa ..aacaccgggagctgttttt | | | | 2361 | C A S S Y S R E N T G E L F F |
| 06.228 | TRBV06-2*01 | TRBJ2-4*01 | TRBD1*01 | 666 | tgtgccagcagtactc | aagg ....caggg... tg ....aaaacattcagtacttc | | | | 2362 | C A S S Y S R Q G E N I Q Y F |

Figure 1-25

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.229 | TRBV06-6*01 | TRBJ1-5*01 | TRBD1*01 | 667 | tgtgccagcagttactc | ga..gacaggg.. | tggg | ......cagcccagcattt | | 2363 | C A S S Y S R Q G G Q P Q H F |
| 06.230 | TRBV06-2*01 | TRBJ2-1*01 | TRBD2*02 | 668 | tgtgccagcagtta.. | ttctcgag.. | tagcggga.. | tt.. ..caatgagcagttcttc | | 2364 | C A S S Y S R V A G F N E Q F |
| 06.231 | TRBV06-5*01 | TRBJ2-1*01 | | 669 | tgtgccagcagttactc | tcg ..ctacaatgagcagttcttc | | | | 2365 | C A S S Y S R Y N E Q F F |
| 06.232 | TRBV06-5*01 | TRBJ1-1*01 | TRBD1*01 | 670 | tgtgccagcagttactc | g t | ......cggg.. | ......cactgaagctttctt | | 2366 | C A S S Y S S G T E A F F |
| 06.233 | TRBV06-6*01 | TRBJ2-7*01 | TRBD2*01 | 671 | tgtgccagcagttactc | tt ..ctagcg.. | ..at ag | ctcctacgagcagtactc | | 2367 | C A S S Y S S S D S S Y E Q Y F |
| 06.234 | TRBV06-5*01 | TRBJ1-2*01 | TRBD1*01 | 672 | tgtgccagcagttactc | ctcggttcc ..gacaggg.. | ttatc | ..ctatggctacacctttc | | 2368 | C A S S Y S S V P T G L S Y G Y T F |
| 06.235 | TRBV06-6*01 | TRBJ2-7*01 | TRBD1*01 | 673 | tgtgccagcagttactc | ..gacag.. | agtctcg | ......cgagcagtactc | | 2369 | C A S S Y S T E S R E Q Y F |
| 06.236 | TRBV06-5*01 | TRBJ1-6*01 | TRBD1*01 | 674 | tgtgccagcagttactc | g gta gggacag.. | ag | ......tcacccctccacttt | | 2370 | C A S S Y S V G T E S P L H F |
| 06.237 | TRBV06-7*01 | TRBJ1-5*01 | | 675 | tgtgccagcagttactc | g gtc agcaatcagcccagcattt | | | | 2371 | C A S S Y S V S N Q P Q H F |
| 06.238 | TRBV06-6*01 | TRBJ2-1*01 | TRBD2*02 | 676 | tgtgccagcagtac.. | actccacgag.. | ..tagcgggag.. | tccgg ........tgagcagttcttc | | 2372 | C A S S Y T P Q S S G R S G E Q F F |
| 06.239 | TRBV06-5*01 | TRBJ1-1*01 | TRBD1*01 | 677 | tgtgccagcagttac.. | gt ......agggg.. | | ......cactgaagctttctt | | 2373 | C A S S Y V G G T E A F F |
| 06.240 | TRBV06-3*01 | TRBJ2-5*01 | TRBD2*01 | 678 | tgtgccagcagttac.. | gta ..acta.. | .......caa ..aagagaccagtactc | | | 2374 | C A S S Y V T T K E T Q Y F |
| 06.241 | TRBV06-5*01 | TRBJ2-7*01 | TRBD2*02 | 679 | tgtgccagcagttact | .........gggaggg ggct | ..tacgagcagtactc | | | 2375 | C A S S Y W E G A Y E Q Y F |
| 06.242 | TRBV06-6*01 | TRBJ2-2*01 | TRBD2*02 | 680 | tgtgccagcagttact | at ......gggaggg aa ..accggggagctgttttt | | | | 2376 | C A S S Y Y G R E T G E L F F |
| 06.243 | TRBV06-6*01 | TRBJ2-1*01 | TRBD2*02 | 681 | tgtgccagca.. | cg ......gcggga.. | a ..cctacaatgagcagttcttc | | | 2377 | C A S T A G T Y N E Q F F |
| 06.244 | TRBV06-5*01 | TRBJ1-2*01 | TRBD2*02 | 682 | tgtgccagca.. | ctgatttttacg ......gcggggag.. | c | ......atggctacacctttc | | 2378 | C A S T D F Y G G R H G Y T F |
| 06.245 | TRBV06-1*01 | TRBJ1-1*01 | TRBD1*01 | 683 | tgtgccagca.. | ccgatccttt ..gacagg.. | catgaacactgaagcttcttt | | | 2379 | C A S T D P L T G M N T E A F F |
| 06.246 | TRBV06-6*01 | TRBJ1-5*01 | TRBD1*01 | 684 | tgtgccagca.. | ccga ..ggac.. | ccgaggg | ......agcccagcattt | | 2380 | C A S T E D P R E P Q H F |
| 06.247 | TRBV06-5*01 | TRBJ1-1*01 | TRBD1*01 | 685 | tgtgccagca.. | cccaccggggaa ......agggg.. | attctgacacttttagg.......... | tttcttt | | 2381 | C A S T H R G K G D S D T L G F F |
| 06.248 | TRBV06-5*01 | TRBJ1-2*01 | TRBD1*01 | 686 | tgtgccagca.. | ccct ..gacagg.. | t ..tatgctacacctc | | | 2382 | C A S T L T G Y G Y T F |
| 06.249 | TRBV06-5*01 | TRBJ2-1*01 | TRBD2*02 | 687 | tgtgccagca.. | coatg ..ctagccgggag.. | ttgaa.. ..accgggggagctgttttt | | | 2383 | C A S T M L A G V E T G E L F F |
| 06.250 | TRBV06-5*01 | TRBJ2-1*01 | TRBD2*01 | 688 | tgtgccagca.. | cccctctg gggactagcgg.... | c ......gagcagttcttc | | | 2384 | C A S T P L G T S G E Q F F |
| 06.251 | TRBV06-2*01 | TRBJ2-7*01 | TRBD2*02 | 689 | tgtgccagca.. | ccca ......cgggag.. | cgcccctc.. ..cgagcagtactc | | | 2385 | C A S T P R E R P S E Q Y F |
| 06.252 | TRBV06-5*01 | TRBJ2-5*01 | TRBD2*01 | 690 | tgtgccagca.. | cccgtc ......cgggg.. | cctgg.. ccaagaaccaccagtactc | | | 2386 | C A S T P S G A W Q E T Q Y F |
| 06.253 | TRBV06-2*01 | TRBJ2-2*01 | TRBD2*01 | 691 | tgtgccagca.. | cc ......cagg.. | tgggcc ......gagctgttttt | | | 2387 | C A S T Q G G A E L F F |
| 06.254 | TRBV06-5*01 | TRBJ2-3*01 | TRBD2*01 | 692 | tgtgccagca.. | cac gggact.. | ct agcacagatacagcagtatttt | | | 2388 | C A S T R D S S T D T Q Y F |
| 06.255 | TRBV06-1*01 | TRBJ1-1*01 | TRBD1*01 | 693 | tgtgccagca.. | cccgt cc gggacaggggc ttctg.. ..acactgaagcttcttt | | | | 2389 | C A S T R P G Q G A S D T E A F F |

Figure 1-26

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 06.256 | TRBV06-5*01 | TRBJ2-2*01 | | 694 | tgtgccagca | cttccgcctcc | | gggagctgttt | | 2390 | C A S T S G L R E L F F |
| 06.257 | TRBV06-6*01 | TRBJ1-1*01 | TRBD2*01 | 695 | tgtgccagca | cca | cgggg | t | tgaacactgaagcttctt | 2391 | C A S T T G L N T E A F F |
| 06.258 | TRBV06-1*01 | TRBJ2-7*01 | TRBD1*01 | 696 | tgtgccagca | ccgt | gggacaggggc | g tgg | gagcagtactc | 2392 | C A S T V G Q G A W E Q Y F |
| 06.259 | TRBV06-1*01 | TRBJ2-3*01 | TRBD2*01 | 697 | tgtgccagc | t | gggac | ccctgaacc | cagatacgcagtatttt | 2393 | C A S W D A L P D T Q Y F |
| 06.260 | TRBV06-3*01 | TRBJ1-1*01 | TRBD1*01 | 698 | tgtgcca | ctga | gggc g tttgg | tgaacactgaagcttctt | | 2394 | C A T E G R L V N T E A F F |
| 07.01 | TRBV07-3*01 | TRBJ2-3*01 | TRBD2*02 | 699 | tgtgcca | teagcatatcgc | cgggag | cccagataccoaa | tatttt | 2395 | C A I S I A G S P D T Q Y F |
| 07.02 | TRBV07-2*01 | TRBJ2-7*01 | TRBD1*01 | 700 | tgtgcc | coaaggaacc | ggacaggggg | agatctcc | acgagcagtactc | 2396 | C A P R N R T G G D L H E Q Y F |
| 07.03 | TRBV07-6*01 | TRBJ2-1*01 | TRBD1*01 | 701 | tgtgcc | tcc ggac | ggag ctcctacaatgagcagttctc | | | 2397 | C A S G R S S Y N E Q F F |
| 07.04 | TRBV07-9*01 | TRBJ2-5*01 | TRBD2*02 | 702 | tgtgccagcag | gttc | gaggg cgg | agagaccagtactc | | 2398 | C A S R F E G G E T Q Y F |
| 07.05 | TRBV07-9*01 | TRBJ2-2*01 | TRBD1*01 | 703 | tgtgccagcag | a | ggacaggg | gaacaaccgggagctgtttt | | 2399 | C A S R G Q G N T G E L F F |
| 07.06 | TRBV07-9*01 | TRBJ2-5*01 | TRBD2*02 | 704 | tgtgccagcag | aac | cggga | actag | gagaccccagtactc | 2400 | C A S R T G N W E T Q Y F |
| 07.07 | TRBV07-8*01 | TRBJ2-7*01 | TRBD1*01 | 705 | tgtgccagcagc | g | agggggc g g | cctacgagcagtactc | | 2401 | C A S S E G A A Y E Q Y F |
| 07.08 | TRBV07-3*01 | TRBJ2-1*01 | TRBD2*01 | 706 | tgtgccagcagctt | c | ctagcgggg | ttttg | aatgagcagttcttc | 2402 | C A S S F L A G V L N E Q F F |
| 07.09 | TRBV07-3*01 | TRBJ2-1*01 | | 707 | tgtgccagcagctt | tatgcc gag ctcctacaatgagcagttcttc | | | | 2403 | C A S S F M A S S Y N E Q F F |
| 07.10 | TRBV07-3*01 | TRBJ2-2*01 | TRBD2*02 | 708 | tgtgccagcagctt | caa | cgggag | a | accgggagctgtttt | 2404 | C A S S F N G R T G E L F F |
| 07.11 | TRBV07-9*01 | TRBJ2-2*01 | TRBD1*01 | 709 | tgtgccagcagctt | cc | gacagg | cagtg | acaccgggagctgtttt | 2405 | C A S S F R Q G S D T G E L F F |
| 07.12 | TRBV07-6*01 | TRBJ2-3*01 | TRBD1*01 | 710 | tgtgccagcagc | gggg tgttggtt | gatacgcagtattt | | | 2406 | C A S S G V L V D T Q Y F |
| 07.13 | TRBV07-3*01 | TRBJ2-3*01 | TRBD2*02 | 711 | tgtgccagcagc | ca | cgggggg | t | cagatacgcagtattt | 2407 | C A S S H G G S D T Q Y F |
| 07.14 | TRBV07-3*01 | TRBJ2-1*01 | TRBD2*02 | 712 | tgtgccagcagc | caca | tagccggaggg | tcctacaatgagcagttcttc | | 2408 | C A S S H I A G G S Y N E Q F F |
| 07.15 | TRBV07-9*03 | TRBJ1-2*01 | TRBD2*01 | 713 | tgtgccagcagc | t | tagccggg | cgggcac | ggctacacctc | 2409 | C A S S L A G G H G Y T F |
| 07.16 | TRBV07-2*02 | TRBJ2-7*01 | TRBD2*01 | 714 | tgtgccagcagctagc | gcta | gggggg | cca | gagcagtactc | 2410 | C A S S L A L G G P E Q Y F |
| 07.17 | TRBV07-6*01 | TRBJ2-3*01 | TRBD2*02 | 715 | tgtgccagcagcttag | g tt | gggactagcgggaggg | cc | cacagatacgcagtattt | 2411 | C A S S L A L G L A G G P T D T Q Y F |
| 07.18 | TRBV07-9*01 | TRBJ2-1*01 | TRBD1*01 | 716 | tgtgccagcagcttagc | ctc | ggacagg | ccccgag | aatgagcagttcttc | 2412 | C A S S L A S D R A P E N E Q F F |
| 07.19 | TRBV07-6*01 | TRBJ1-2*01 | TRBD1*01 | 717 | tgtgccagcagctag | ac | ggggg | aggaggg | ggctacacctc | 2413 | C A S S L D G G G G G Y T F |
| 07.20 | TRBV07-3*01 | TRBJ2-3*01 | TRBD2*02 | 718 | tgtgccagcagctta | gacgg | gcggga | tgt | agatacgcagtattt | 2414 | C A S S L D G R D V D T Q Y F |
| 07.21 | TRBV07-9*01 | TRBJ2-5*01 | | 719 | tgtgccagcagcttag | atccg | caagagacccagtactc | | | 2415 | C A S S L D P Q E T Q Y F |
| 07.22 | TRBV07-9*01 | TRBJ2-2*01 | TRBD1*01 | 720 | tgtgccagcagctag | acag | a | aacaccgggagctgtttt | | 2416 | C A S S L D R N T G E L F F |

Figure 1-27

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 07.23 | TRBV07-2*02 | TRBJ2-3*01 | TRBD2*01 | 721 | tgtgccagcagcttag. | accggt. | ggga. | tgggagcaacagatacgcagtatttt | | 2417 | C A S S L D R W D G S T D T Q Y F |
| 07.24 | TRBV07-9*01 | TRBJ1-5*01 | | 722 | tgtgccagcagcttag. | actgg. | ...aatcagcccagcattt | | | 2418 | C A S S L D W N Q P Q H F |
| 07.25 | TRBV07-9*01 | TRBJ2-1*01 | TRBD2*01 | 723 | tgtgccagcagcttag. | a | gga. | ctcctacaatgagcagttctc | | 2419 | C A S S L E D S Y N E Q F F |
| 07.26 | TRBV07-9*01 | TRBJ2-5*01 | TRBD2*01 | 724 | tgtgccagcagcttag. | a | ...acta. | atcgttg. | ..aagagaccagtactc | 2420 | C A S S L E L I V E E T Q Y F |
| 07.27 | TRBV07-9*01 | TRBJ2-5*01 | TRBD2*01 | 725 | tgtgccagcagcttag. | a | ...acta. | agcgttg. | ...aagagaccagtactc | 2421 | C A S S L E L S V E E T Q Y F |
| 07.28 | TRBV07-2*03 | TRBJ2-7*01 | | 726 | tgt. | gccagcagcttagaaagtgcgttgga. | ...ctacgagcagtactc | | | 2422 | C A S S L E V A L D Y E Q Y F |
| 07.29 | TRBV07-6*01 | TRBJ2-3*01 | TRBD2*02 | 727 | tgtgccagcagcta. | ttt. | ...gcggag. | ...cagatacgcagtatttt | | 2423 | C A S S L F A G A D T Q Y F |
| 07.30 | TRBV07-2*03 | TRBJ2-1*01 | TRBD2*01 | 728 | tgt. | gccagcagcctcttcc. | ...ctagcg. | a | ...ctacaatgagcagttctc | 2424 | C A S S L F P S D Y N E Q F F |
| 07.31 | TRBV07-6*01 | TRBJ1-4*01 | TRBD2*01 | 729 | tgtgccagcagctt. | gggggg gg. | ...tgaaaaactgtttt | | | 2425 | C A S S L G G G E K L F F |
| 07.32 | TRBV07-9*01 | TRBJ2-1*01 | TRBD2*01 | 730 | tgtgccagcagcta. | ...ggggg. | ...aatgagcagttctc | | | 2426 | C A S S L G G N E Q F F |
| 07.33 | TRBV07-9*01 | TRBJ1-1*01 | TRBD1*01 | 731 | tgtgccagcagc. | ctt. | ...ggggg. | ...cactgaagcttcttt | | 2427 | C A S S L G G T E A F F |
| 07.34 | TRBV07-8*01 | TRBJ2-7*01 | TRBD1*01 | 732 | tgtgccagcagctt. | gggacagggggc. | ca | ...acgagcagtactc | | 2428 | C A S S L G Q G A N E Q Y F |
| 07.35 | TRBV07-9*01 | TRBJ1-2*01 | TRBD1*01 | 733 | tgtgccagcagcttag. | ggcgtga. | .gacagggg. | aagt. | ...ctatgctgcacctc | 2429 | C A S S L G R E T G E V Y G Y T F |
| 07.36 | TRBV07-9*01 | TRBJ2-1*01 | TRBD2*01 | 734 | tgtgccagcagctt. | g | gggactagcg. | | ...atgagcagttctc | 2430 | C A S S L G T S D E Q F F |
| 07.37 | TRBV07-2*03 | TRBJ2-7*01 | TRBD1*01 | 735 | tgt. | gccagcagctt. | ...aggg. | tacgtcag. | ...cgagcagtactc | 2431 | C A S S L G Y V S E Q Y F |
| 07.38 | TRBV07-9*01 | TRBJ2-1*01 | TRBD1*01 | 736 | tgtgccagcagctta. | att. | ...ggggg. | tttcggt. | .ctacaatgagcagttctc | 2432 | C A S S L I G V S V Y N E Q F F |
| 07.39 | TRBV07-2*02 | TRBJ1-1*01 | TRBD1*01 | 737 | tgtgccagcagctta. | aaagtact. | ggga. | | ...gaagctttttt | 2433 | C A S S L K V L G E A F F |
| 07.40 | TRBV07-2*01 | TRBJ1-3*01 | TRBD1*01 | 738 | tgtgccagcagctta. | cto. | ...ggggg. | atac. | ...ggaaacaccatatttt | 2434 | C A S S L L G G Y G N T I Y F |
| 07.41 | TRBV07-9*01 | TRBJ2-3*01 | TRBD2*02 | 739 | tgtgccagcagctt. | gatggagt. | ...cggga. | ttgggggag. | ...agatacgcagtatttt | 2435 | C A S S L M E S G L V G R D T Q Y F |
| 07.42 | TRBV07-9*01 | TRBJ2-1*01 | TRBD2*01 | 740 | tgtgccagcagcta. | atgggc. | ggac. | | ...atgagcagttctc | 2436 | C A S S L M G G H E Q F F |
| 07.43 | TRBV07-2*03 | TRBJ1-4*01 | TRBD1*01 | 741 | tgt. | gccagcagcttaatggg. | gggacagg. | c | ...aatgaaaaactgtttt | 2437 | C A S S L M G G T G N E K L F F |
| 07.44 | TRBV07-2*01 | TRBJ2-5*01 | TRBD2*01 | 742 | tgtgccagcagcttaa. | aat cc gggactagcg. | | ...aagagaccagtactc | | 2438 | C A S S L N P G L A E E T Q Y F |
| 07.45 | TRBV07-9*01 | TRBJ2-1*01 | TRBD1*01 | 743 | tgtgccagcagcttaa. | accccctcgcccg. | c gggacag. | | ...acaatgagcagttctc | 2439 | C A S S L N P L A R G T D N E Q F F |
| 07.46 | TRBV07-3*01 | TRBJ2-3*01 | TRBD2*01 | 744 | tgtgccagcagcttaa. | gaggtt. | .ggactagcg. | a | ..cacagatacgcagtatttt | 2440 | C A S S L R G W T S D T D T Q Y F |
| 07.47 | TRBV07-3*01 | TRBJ2-6*01 | TRBD2*01 | 745 | tgtgccagcagcttaa. | gt. | ...gcgg. | ...ctggggccaacgtcctgacttc | | 2441 | C A S S L S A A G A N V L T F |
| 07.48 | TRBV07-3*01 | TRBJ2-3*01 | TRBD2*02 | 746 | tgtgccagcagcta. | tccgc. | ...cgggag. | cc. | ...cagatacgcagtatttt | 2442 | C A S S L S A G S P D T Q Y F |
| 07.49 | TRBV07-3*01 | TRBJ2-1*01 | TRBD2*02 | 747 | tgtgccagcagctta. | g. | ...tagcgggag. | cattg. | ...atgagcagttctc | 2443 | C A S S L S S G S I D E Q F F |
| 07.50 | TRBV07-2*03 | TRBJ2-3*01 | TRBD2*02 | 748 | tgt. | gccagcagctgacgg. | ...gcgggaggg. | | ...cagatacgcgcagtatttt | 2444 | C A S S L T G G R A D T Q Y F |

Figure 1-28

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 07.51 | TRBV07-3*01 | TRBJ2-7*01 | TRBD1*01 | 749 | tgtgccagcagcttaac | a | gggacagg | agtg | tacgagcagtacttc | 2445 | C A S S L T G T G V Y E Q Y F |
| 07.52 | TRBV07-3*01 | TRBJ2-1*01 | TRBD2*02 | 750 | tgtgccagcagctt | gactagcgggag | ctcctacaatgagcagttctc | | | 2446 | C A S S L T S G S S Y N E Q F F |
| 07.53 | TRBV07-9*01 | TRBJ2-7*01 | TRBD2*01 | 751 | tgtgccagcagcttag | tag | acggaa | cctacgagcagtactc | | 2447 | C A S S L V D G T Y E Q Y F |
| 07.54 | TRBV07-8*01 | TRBJ2-7*01 | TRBD2*02 | 752 | tgtgccagcagcttag | ttcctcct | ggactagcgggag | tcgaagga | tacgagcagtactc | 2448 | C A S S L V P P G L A G V E G Y E Q Y F |
| 07.55 | TRBV07-9*01 | TRBJ2-5*01 | TRBD1*01 | 753 | tgtgccagcagcttag | tt | cagg | c | ccaagagaccagtactc | 2449 | C A S S L V Q A Q E T Q Y F |
| 07.56 | TRBV07-9*01 | TRBJ2-2*01 | TRBD1*01 | 754 | tgtgccagcagctta | tggga | gacaggg | aaatcgac | caccgggagctgttttt | 2450 | C A S S L W E T G K S T T G E L F F |
| 07.57 | TRBV07-9*01 | TRBJ2-2*01 | TRBD2*02 | 755 | tgtgccagcagctta | tactttgt | ggactagcggga | c | ccggggagctgtttt | 2451 | C A S S L Y F G G L A G P G E L F F |
| 07.58 | TRBV07-8*01 | TRBJ2-7*01 | TRBD2*01 | 756 | tgtgccagcagc | at | gggactagcgg | agaccta | tacgagcagtactc | 2452 | C A S S M G L A E T L Y E Q Y F |
| 07.59 | TRBV07-3*01 | TRBJ2-1*01 | TRBD1*01 | 757 | tgtgccagcagc | cccgaccccat | agggg | atcc | acgagcagttctc | 2453 | C A S S P D P H R G I H E Q F F |
| 07.60 | TRBV07-2*03 | TRBJ2-1*01 | | 758 | tgt | gccagcagccga | ctacacagcagttctc | | | 2454 | C A S S P D Y N E Q F F |
| 07.61 | TRBV07-9*01 | TRBJ2-1*01 | TRBD2*02 | 759 | tgtgccagcagc | ccc | gggactagccgggaggg | t | caatgagcagttctc | 2455 | C A S S P G T S G R V N E Q F F |
| 07.62 | TRBV07-2*03 | TRBJ1-3*01 | | 760 | tgt | gccagcagccaattgggtctgag | tctggaaacaccatatatt | | | 2456 | C A S S P I G S E S G N T I Y F |
| 07.63 | TRBV07-9*01 | TRBJ2-1*01 | TRBD1*01 | 761 | tgtgccagcagc | cccggg | caggggc | g atat | caatgagcagttctc | 2457 | C A S S P R A G G D I N E Q F F |
| 07.64 | TRBV07-9*01 | TRBJ2-7*01 | TRBD2*02 | 762 | tgtgccagcagc | cct | cggga | gaacaccgggagcgtttt | | 2458 | C A S S P R E N T G E L F F |
| 07.65 | TRBV07-9*01 | TRBJ2-1*01 | TRBD2*01 | 763 | tgtgccagcagc | cca | cgggg | a | acgagcagtactc | 2459 | C A S S P R G N E Q Y F |
| 07.66 | TRBV07-2*03 | TRBJ2-7*01 | TRBD2*01 | 764 | tgt | gccagcagccc | ggactagcg | agtg | gttcttc | 2460 | C A S S P R T S E W F F |
| 07.67 | TRBV07-2*02 | TRBJ2-2*01 | TRBD2*01 | 765 | tgtgccagcagc | ccaa | ggact | | acggggagctgtttt | 2461 | C A S S P R T T G E L F F |
| 07.68 | TRBV07-9*01 | TRBJ2-2*01 | TRBD1*01 | 766 | tgtgccagcagc | cc | gacagggc | gcagg | cgggggagctgtttt | 2462 | C A S S P T G G A G G E L F F |
| 07.69 | TRBV07-3*01 | TRBJ2-1*01 | TRBD1*01 | 767 | tgtgccagcagc | cccta ccc gggaca | aaa | ctacaatgagcagttctc | | 2463 | C A S S P Y P G Q N Y N E Q F F |
| 07.70 | TRBV07-3*01 | TRBJ2-1*01 | TRBD2*01 | 768 | tgtgccagcagc | ccgtataggt | cta | ata | acaatgagcagttctc | 2464 | C A S S P Y R S N N N E Q F F |
| 07.71 | TRBV07-9*01 | TRBJ2-6*01 | TRBD1*01 | 769 | tgtgccagcagc | caggg | tccc | ctggggccaacgtcctgacttc | | 2465 | C A S S Q G P P G A N V L T F |
| 07.72 | TRBV07-9*01 | TRBJ2-7*01 | | 770 | tgtgccagcagc | cgtgatctccc ctctacgagcagtactc | | | | 2466 | C A S S R D L P S Y E Q Y F |
| 07.73 | TRBV07-9*01 | TRBJ2-3*01 | | 771 | tgtgccagcagc | cgtcccg | gcacagatacgcagtttt | | | 2467 | C A S S R P G T D T Q Y F |
| 07.74 | TRBV07-8*01 | TRBJ1-2*01 | TRBD1*01 | 772 | tgtgccagcagc | cggactatacgtact | cc gggacag | ctaactatgctacacctc | | 2468 | C A S S R T Y T Y S G T A N Y G Y T F |
| 07.75 | TRBV07-2*03 | TRBJ2-7*01 | TRBD1*01 | 773 | tgt | gccagcagcagat gggacag | c ag ctcctacgagcagtactc | | | 2469 | C A S S R W D S S Y E Q Y F |
| 07.76 | TRBV07-6*01 | TRBJ2-5*01 | TRBD2*02 | 774 | tgtgccagcagct | ccga | agcgggag | ca caagagaccagtactc | | 2470 | C A S S E A G A Q E T Q Y F |
| 07.77 | TRBV07-9*01 | TRBJ1-1*01 | | 775 | tgtgccagcagct | ccgag a tgaacactgaagcttctt | | | | 2471 | C A S S E M N T E A F F |
| 07.78 | TRBV07-7*01 | TRBJ2-2*01 | TRBD2*01 | 776 | tgtgc | tagc | agcagcggagat | gaacaccgggagctgtttt | | 2472 | C A S S E M N T G E L F F |

Figure 1-29

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 07.79 | TRBV07-9*01 | TRBJ2-7*01 | TRBD2*02 | 777 | tgtgccagcagct... | ct..ggactagcggagg. | tgc.gag | ctccacgagcagtacttc | | 2473 | C A S S G L A G G A S S Y E Q Y F |
| 07.80 | TRBV07-2*03 | TRBJ2-1*01 | TRBD2*01 | 778 | tgt... | ...gccagcagctc | ....cggg.. | tcctacaatgagcagttctc | | 2474 | C A S S G S Y N E Q F F |
| 07.81 | TRBV07-9*01 | TRBJ2-1*01 | TRBD2*01 | 779 | tgtgccagcagct... | caatta..gactagc....... | cg ... | acaatgagcagttcttc | | 2475 | C A S S I R L A D N E Q F F |
| 07.82 | TRBV07-9*01 | TRBJ1-2*01 | | 780 | tgtgccagcagct... | ccctattatc ... | ctatgctacacttc | | | 2476 | C A S S L L S Y G Y T F |
| 07.83 | TRBV07-9*01 | TRBJ1-2*01 | TRBD1*01 | 781 | tgtgccagcagct... | caaact.ggga.. | ......to..acatgctacacctc | | | 2477 | C A S S N W D H Y G Y T F |
| 07.84 | TRBV07-3*01 | TRBJ2-2*01 | TRBD1*01 | 782 | tgtgccagcagc... | agct.cc.gggacaggg... | t ... | acaccgggagctgtttt | | 2478 | C A S S G T G Y T G E L F F |
| 07.85 | TRBV07-9*01 | TRBJ2-7*01 | TRBD2*01 | 783 | tgtgccagcagct... | cc...actagcgggg.. | ctcctacgagcagtactc | | | 2479 | C A S S T S G G S Y E Q Y F |
| 07.86 | TRBV07-8*01 | TRBJ2-3*01 | | 784 | tgtgccagcagct... | catacgacg. | ...cagatacgcagtattt | | | 2480 | C A S S Y D A D T Q Y F |
| 07.87 | TRBV07-9*01 | TRBJ2-1*01 | TRBD2*01 | 785 | tgtgccagcag... | ta.cc.gggactagcg... | ..at... | tacaatgagcagttctc | | 2481 | C A S S T G T S D Y N E Q F F |
| 07.88 | TRBV07-2*02 | TRBJ2-1*01 | TRBD2*02 | 786 | tgtgccagcagct... | gggcgg. | .....agcgggaggg..ggct..... | ..atgagcagttcttc | | 2482 | C A S S W G G A G G G Y E Q F F |
| 07.89 | TRBV07-6*01 | TRBJ1-3*01 | TRBD1*01 | 787 | tgtgccagcagct... | g.gggact... | gaa.ctctgaaacacatatattt | | | 2483 | C A S S W G L N S G N T I Y F |
| 07.90 | TRBV07-9*01 | TRBJ2-1*01 | TRBD2*01 | 788 | tgtgccagcagct... | accct ...acaggg... | tcctacaatgagcagttctc | | | 2484 | C A S S Y P T G S Y N E Q F F |
| 07.91 | TRBV07-9*01 | TRBJ2-1*01 | TRBD1*01 | 789 | tgt gcc agc acc gaa ctt acg gga ccc cgg gca aac gag ttc ttc | | | | | 2485 | C A S T E L T G P R A N E Q F F |
| 07.92 | TRBV07-3*01 | TRBJ2-1*01 | TRBD2*02 | 790 | tgtgccagca... | .....cct ...tagcggaggg..gt | .....caatgagcagttctc | | | 2486 | C A S T L A G G V N E Q F F |
| 09.01 | TRBV09*01 | TRBJ1-2*01 | TRBD1*01 | 791 | tgtgccagcagcg... | cc.gggac... | g.g.ctaactatgctacacctc | | | 2487 | C A S S A G T A N Y G Y T F |
| 09.02 | TRBV09*01 | TRBJ1-2*01 | TRBD1*01 | 792 | tgtgccagcagcg... | .....caggg... | tatcgcgg | ....ggctacacctc | | 2488 | C A S S A G V S R G Y T F |
| 09.03 | TRBV09*01 | TRBJ2-3*01 | TRBD1*01 | 793 | tgtgccagcagcg... | cccacca.gggactag... | atcttgg... | agatacgcagtatttt | | 2489 | C A S S A H Q G L D L G D T Q Y F |
| 09.04 | TRBV09*01 | TRBJ2-3*01 | TRBD2*02 | 794 | tgtgccagcagcg... | ccctcac..... | ..cggga.. | accc ..cacagatacgcagtattt | | 2490 | C A S S A L T G N P T D T Q Y F |
| 09.05 | TRBV09*01 | TRBJ1-1*01 | TRBD1*01 | 795 | tgtgccagcagcg... | ctt cc.gggacag... | c ... | gaacactgaagcttctt | | 2491 | C A S S A S G T A N T E A F F |
| 09.06 | TRBV09*01 | TRBJ1-1*01 | TRBD2*01 | 796 | tgtgccagcagcg... | cctcacagg.. | ...gcggggg... | cactgaagcttctt | | 2492 | C A S S A S Q G G G T E A F F |
| 09.07 | TRBV09*01 | TRBJ1-1*01 | TRBD1*01 | 797 | tgtgccagcagcg... | cca.cc.gggac.. | ......tggagg | ...cactgaagcagtactc | | 2493 | C A S S A T G T G G T E A F F |
| 09.08 | TRBV09*01 | TRBJ2-7*01 | TRBD1*01 | 798 | tgtgccagcagcg... | c..gactagcgg... | cgacct..ctacgagcagtactc | | | 2494 | C A S S A T S G D L Y E Q Y F |
| 09.09 | TRBV09*01 | TRBJ2-7*01 | TRBD1*01 | 799 | tgtgccagcagcg... | ccacta cc.gggaca... | ...att ... | tacgagcagtactc | | 2495 | C A S S A T T G T I Y E Q Y F |
| 09.10 | TRBV09*01 | TRBJ1-1*01 | TRBD1*01 | 800 | tgtgccagcagcg... | catat ..ggacagg... | ...cactgaagcttctt | | | 2496 | C A S S A Y G Q G T E A F F |
| 09.11 | TRBV09*01 | TRBJ2-5*01 | TRBD1*01 | 801 | tgtgccagcagcg... | cctatcctgaa.ggacagg... | ccaaga ... | ....ccagtacttc | | 2497 | C A S S A Y P E G T G Q D Q Y F |
| 09.12 | TRBV09*01 | TRBJ2-3*01 | TRBD2*01 | 802 | tgtgccagcagcg... | a c.gggactagccg... | aagaggg ... | gatacgcagtatttt | | 2498 | C A S S D G T S G R G D T Q Y F |
| 09.13 | TRBV09*01 | TRBJ2-6*01 | TRBD2*01 | 803 | tgtgccagcg... | agca.. | ....cgggg... | ctggggccaactgctgacttc | | 2499 | C A S S E H G A G A N V L T F |

Figure 1-30

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 09.14 | TRBV09*01 | TRBJ2-3*01 | TRBD2*01 | 804 | tgtgccagcagcg... | aat cc | gggacta... | c | ...cacagatacgcagtattt | 2500 | C A S S E S G T T T D T Q Y F |
| 09.15 | TRBV09*01 | TRBJ2-3*01 | TRBD1*01 | 805 | tgtgccagcagcg... | aat .ggacag.... | ct agcacagatacgcagtattt | | | 2501 | C A S S E W T A S T D T Q Y F |
| 09.16 | TRBV09*01 | TRBJ1-4*01 | TRBD1*01 | 806 | tgtgccagcagcg... | agt ...acaggg. | agtgggg ......gaaaaactgttttt | | | 2502 | C A S S E Y R G V G E K L F F |
| 09.17 | TRBV09*01 | TRBJ2-7*01 | TRBD2*01 | 807 | tgtgccagcagc.... | ttc .ggactag... | ...ngggaccccagcctacnagcan | ...........tactc | | 2503 | C A S S F G L G G P P A Y E H Y F |
| 09.18 | TRBV09*01 | TRBJ1-4*01 | TRBD1*01 | 808 | tgtgccagcagcg... | gggatt ...caggg.. | taacag.........aactgttttt | | | 2504 | C A S S G D S G V T E L F F |
| 09.19 | TRBV09*01 | TRBJ2-7*01 | | 809 | tgtgccagcagcg... | gaga ctcctacgagcagttcttc | | | | 2505 | C A S S G D S Y E Q Y F |
| 09.20 | TRBV09*01 | TRBJ2-7*01 | TRBD1*01 | 810 | tgtgccagcagcg... | gcgaa .gacag... | ctcctacgagcagttcttc | | | 2506 | C A S S G E D S S Y E Q Y F |
| 09.21 | TRBV09*01 | TRBJ2-7*01 | TRBD2*01 | 811 | tgtgccagcagcg... | gggggg ... | agcgga... | ta .cctacgagcagttcttc | | 2507 | C A S S G G E R G T Y E Q Y F |
| 09.22 | TRBV09*01 | TRBJ2-6*01 | TRBD1*01 | 812 | tgtgccagcagcg... | ...gacagggg... | ttat ctctgggccaactgcctgacttc | | | 2508 | C A S S G Q G V I S G A N V L T F |
| 09.23 | TRBV09*01 | TRBJ2-5*01 | TRBD2*01 | 813 | tgtgccagcagcg... | gtt ...ctagcgggg.. | t ....gagaccagtactc | | | 2509 | C A S S G S S G G E T Q Y F |
| 09.24 | TRBV09*01 | TRBJ2-3*01 | TRBD1*01 | 814 | tgtgccagcagc.... | ttaga ...agggg.. | tatc ..cacagatacgcagtattt | | | 2510 | C A S S L E G V S T D T Q Y F |
| 09.25 | TRBV09*01 | TRBJ1-6*01 | TRBD1*01 | 815 | tgtgccagcagc.... | ttaggag c gggacagg... | aa ........taccccctccacttt | | | 2511 | C A S S L G A G Q E S P L H F |
| 09.26 | TRBV09*01 | TRBJ2-3*01 | TRBD1*01 | 816 | tgtgccagcagc.... | tta .....ggggc t | agcacagatacgcagtattt | | | 2512 | C A S S L G A S T D T Q Y F |
| 09.27 | TRBV09*01 | TRBJ1-5*01 | TRBD1*01 | 817 | tgtgccagcagc.... | ctcg gggac..... | ggatt ...caatcagccccagcattt | | | 2513 | C A S S L G D G F N Q P Q H F |
| 09.28 | TRBV09*01 | TRBJ2-7*01 | TRBD2*01 | 818 | tgtgccagcagc.... | tt gggactag..... | ggggatcccccagcctactac... | ......cagtactc | | 2514 | C A S S L G L G G S P A Y Y Q Y F |
| 09.29 | TRBV09*01 | TRBJ1-5*01 | TRBD2*01 | 819 | tgtgccagcagc.... | ct c gggaca..... | aac agcaatcagcccccagcagtcttc | | | 2515 | C A S S L G T N S N Q P Q H F |
| 09.30 | TRBV09*01 | TRBJ2-1*01 | TRBD1*01 | 820 | tgtgccagcagc.... | ct ..acaggggg... | g ctcctacaatgagcagttctc | | | 2516 | C A S S L Q G G S Y N E Q F F |
| 09.31 | TRBV09*01 | TRBJ2-2*01 | TRBD2*01 | 821 | tgtgccagcagc.... | ctccgggg..... | tagcgggg... | tcg ....ccggggagctgtttt | | 2517 | C A S S L R G S G V A G E L F |
| 09.32 | TRBV09*01 | TRBJ2-7*01 | TRBD1*01 | 822 | tgtgccagcagc.... | cc gggacaggg... | ctcctacgagcagtactc | | | 2518 | C A S S P G Q G S Y E Q Y F |
| 09.33 | TRBV09*01 | TRBJ1-5*01 | | 823 | tgtgccagcagc.... | ccccattggtctgt | ......tcagcccccagcattt | | | 2519 | C A S S P H W S V Q P Q H F |
| 09.34 | TRBV09*01 | TRBJ2-1*01 | | 824 | tgtgccagcagc.... | cccccctgccgtcc ctcctacaatgagcagttcttc | | | | 2520 | C A S S P P A G P S Y N E Q F F |
| 09.35 | TRBV09*01 | TRBJ2-1*01 | TRBD2*01 | 825 | tgtgccagcagc.... | ccaca .....acg..... | agt .tcctacaatgagcagttcttc | | | 2521 | C A S S P Q A S S Y N E Q F F |
| 09.36 | TRBV09*01 | TRBJ1-5*01 | TRBD1*01 | 826 | tgtgccagcagc.... | cccac .ggacag.... | cgg .....atcagcccccagcattt | | | 2522 | C A S S P T D R A D Q P Q H F |
| 09.37 | TRBV09*01 | TRBJ2-1*01 | TRBD2*01 | 827 | tgtgccagcagc.... | c .......gcgg..... | a tgaacactgaagcttctt | | | 2523 | C A S S R G M N T E A F F |
| 09.38 | TRBV09*01 | TRBJ2-5*01 | TRBD1*01 | 828 | tgtgccagcag..... | tcgtt .ggac..... | cgctcc ..ccaagagaccagtactc | | | 2524 | C A S S R W T A P Q E T Q Y F |
| 09.39 | TRBV09*01 | TRBJ2-1*01 | TRBD2*02 | 829 | tgtgccacag...... | tctaa .....agcggagg... | Ctcctacaatgagcagttcttc | | | 2525 | C A S S S K A G G S Y N E Q F F |
| 09.40 | TRBV09*01 | TRBJ2-5*01 | TRBD2*01 | 830 | tgtgccagcagc.... | tccc .......gcggggagg | gg ..caagagaccagtactc | | | 2526 | C A S S S R G R G Q E T Q Y F |
| 09.41 | TRBV09*01 | TRBJ2-1*01 | TRBD2*01 | 831 | tgtgccagcagc.... | ag .....tagcggggg. | cgga ....aatgagcagttcttc | | | 2527 | C A S S S R G R G G G N E Q F F |

Figure 1-31

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 09.42 | TRBV09*01 | TRBJ2-2*01 | TRBD1*01 | 832 | tgtgccagcagcgtag | cagg | ...t | ...cggggagctgtttt | | 2528 | C A S S V A G S G E L F F |
| 09.43 | TRBV09*01 | TRBJ1-1*01 | TRBD1*01 | 833 | tgtgccagcagcgtag | ct t | ...acaggg... | cgg.......tgaagctttctt | | 2529 | C A S S V A Y R G G E A F F |
| 09.44 | TRBV09*01 | TRBJ1-2*01 | | 834 | tgtgccagcagcgtag | atg | ...agggg... | acccc.......ctacacctc | | 2530 | C A S S V D E G T P Y T F |
| 09.45 | TRBV09*01 | TRBJ2-7*01 | TRBD1*01 | 835 | tgtgccagcagcgtag | atg | ...gggggc attc | ctcctacgagcagtactc | | 2531 | C A S S V D G G H S S Y E Q Y F |
| 09.46 | TRBV09*01 | TRBJ1-5*01 | TRBD2*02 | 836 | tgtgccagcagcgtag | a | ...cggga... | a tagcaatcagcccagcagatttt | | 2532 | C A S S V D G N S N Q P Q H F |
| 09.47 | TRBV09*01 | TRBJ2-1*01 | TRBD2*01 | 837 | tgtgccagcagcgtag | accttgtg | ggga......... | ...acaatgagcagttcttc | | 2533 | C A S S V D L V G N N E Q F F |
| 09.48 | TRBV09*02 | TRBJ2-1*01 | TRBD2*01 | 838 | tgtgccagcagcgtag | ac | ...agcgggg... | aa ...tacaatgagcagttcttc | | 2534 | C A S S V D S G E Y N E Q F F |
| 09.49 | TRBV09*01 | TRBJ2-1*01 | TRBD1*01 | 839 | tgtgccagcagcgtag | agg | ...ctagcgg... | ...ctacaatgagcagttcttc | | 2535 | C A S S V E A S G Y N E Q F F |
| 09.50 | TRBV09*01 | TRBJ2-3*01 | TRBD1*01 | 840 | tgtgccagcagcgtag | a | ......gggc agg | agcacagatacgcagtattt | | 2536 | C A S S V E G R S T D T Q Y F |
| 09.51 | TRBV09*01 | TRBJ2-1*01 | TRBD1*01 | 841 | tgtgccagcagcgtag | agtat | ....agggg... | ......aatgagcagttcttc | | 2537 | C A S S V E Y R G N E Q F F |
| 09.52 | TRBV09*01 | TRBJ2-1*01 | TRBD1*01 | 842 | tgtgccagcagcgtag | | ...gggc atttgacgg | ....tgagcagttcttc | | 2538 | C A S S V G A F D G E Q F F |
| 09.53 | TRBV09*01 | TRBJ2-4*01 | TRBD1*01 | 843 | tgtgccagcagcgtag | gg | ......gcggg... | agccaaaaacattcagtactc | | 2539 | C A S S V G A G A K N I Q Y F |
| 09.54 | TRBV09*01 | TRBJ2-1*01 | TRBD2*02 | 844 | tgtgccagcagcgtag | g | ...agcgggaggg cc | ...caatgagcagttcttc | | 2540 | C A S S V G A G G P N E Q F F |
| 09.55 | TRBV09*01 | TRBJ2-5*01 | TRBD2*01 | 845 | tgtgccagcagcgt. | t | ......ggggg... | ......agagaccagtactc | | 2541 | C A S S V G G E T Q Y F |
| 09.56 | TRBV09*01 | TRBJ2-1*01 | TRBD2*02 | 846 | tgtgccagcagcgtag | ga | ......ggaggg c tgg | ....acaatgagcagttcttc | | 2542 | C A S S V G G G L D N E Q F F |
| 09.57 | TRBV09*01 | TRBJ2-3*01 | TRBD1*01 | 847 | tgtgccagcagcgtag | | ......ggggc aggg | gcacagatacgcagtattt | | 2543 | C A S S V G G R G T D T Q Y F |
| 09.58 | TRBV09*01 | TRBJ2-1*01 | TRBD2*02 | 848 | tgtgccagcagcgtag | | ...gccggag... cg | ...cctacaatgagcagttcttc | | 2544 | C A S S V G G S A Y N E Q F F |
| 09.59 | TRBV09*01 | TRBJ2-6*01 | TRBD2*02 | 849 | tgtgccagcagcgtag | ggcat ggg | ............ | ...tctggggcaacgtcctgactttt | | 2545 | C A S S V G H G S G A N V L T F |
| 09.60 | TRBV09*01 | TRBJ2-2*01 | TRBD1*01 | 850 | tgtgccagcagcgt. | gggaca..... | cctcctg | ....accgggggagctgtttt | | 2546 | C A S S V G H L L T G E L F F |
| 09.61 | TRBV09*01 | TRBJ2-7*01 | TRBD2*02 | 851 | tgtgccagcagcgt. | c | ...ggactagcggga... | cccccag ...cctacgagcagtactc | | 2547 | C A S S V G L A G P P A Y E Q Y F |
| 09.62 | TRBV09*01 | TRBJ2-7*01 | TRBD2*02 | 852 | tgtgccagcagcgt. | c | ...ggactagcggga... | ccccccagcctacgt.......gcagtactc | | 2548 | C A S S V G L A G P P A Y V Q Y F |
| 09.63 | TRBV09*01 | TRBJ2-7*01 | TRBD2*01 | 853 | tgtgccagcagcgt. | c | ...ggacta...... | ccggaccccag ...cctacgagcagtactc | | 2549 | C A S S V G L P G P P A Y E Q Y F |
| 09.64 | TRBV09*01 | TRBJ2-5*01 | TRBD2*02 | 854 | tgtgccagcagcgtag | gcaa | ...tagcggga... | ...aagagaccagtactc | | 2550 | C A S S V G N S G K E T Q Y F |
| 09.65 | TRBV09*01 | TRBJ1-6*01 | TRBD2*01 | 855 | tgtgccagcagcgtag | gg | ......agcgg... | tacggga........tcaccctccactt | | 2551 | C A S S V G S G T G S P L H F |
| 09.66 | TRBV09*01 | TRBJ2-7*01 | TRBD1*01 | 856 | tgtgccagcagcgt. | c | gggacaggggg | gatgtgg ......gagcagtactc | | 2552 | C A S S V G T G G M W E Q Y F |
| 09.67 | TRBV09*01 | TRBJ1-6*01 | TRBD1*01 | 857 | tgtgccagcagcgtag | gggtgg | ....agggg... tc | ......aattcacccctccactt | | 2553 | C A S S V G V E G V N S P L H F |
| 09.68 | TRBV09*01 | TRBJ2-1*01 | TRBD2*02 | 858 | tgtgccagcagcgt. | cccctc | ...gactagcggagg... | to ...acaatgagcagttcttc | | 2554 | C A S S V P R L A G G H N E Q F F |
| 09.69 | TRBV09*01 | TRBJ2-1*01 | TRBD2*02 | 859 | tgtgccagcagcgta. | ccttatcg | ......gggaag... | .......tgagcagttcttc | | 2555 | C A S S V P Y R G G E Q F F |

Figure 1-32

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 09.70 | TRBV09*01 | TRBJ2-7*01 | TRBD2*02 | 860 | tgtgccagcagcgt..cc | ......agcggaggg | cggt | ......gagcagtactc | | 2556 | C A S S V Q R E G G E Q Y F |
| 09.71 | TRBV09*01 | TRBJ2-7*01 | TRBD2*02 | 861 | tgtgccagcagcgta. agt | ......gggagg | ..ctacgagcagtactc | | | 2557 | C A S S V R W E G Y E Q Y F |
| 09.72 | TRBV09*01 | TRBJ2-1*01 | TRBD1*01 | 862 | tgtgccagcagcgta. to | .......gggc g | ..cctacaatgagcagttcttc | | | 2558 | C A S S V S G A Y N E Q F F |
| 09.73 | TRBV09*01 | TRBJ2-1*01 | TRBD2*02 | 863 | tgtgccagcagcgta. t | .......cgggag. | a ...ctacaatgagcagttcttc | | | 2559 | C A S S V S G D Y N E Q F F |
| 09.74 | TRBV09*01 | TRBJ1-5*01 | TRBD1*01 | 864 | tgtgccagcagcgta. tcc | ......ggggg. | ..gcaatcagcccagcattt | | | 2560 | C A S S V S G G N Q P Q H F |
| 09.75 | TRBV09*01 | TRBJ2-2*01 | TRBD2*01 | 865 | tgtgccagcagcgta. tct gggact. | .......caaccg. | ...acaccgggagcgtgtttt | | | 2561 | C A S S V S G T Q P D T G E L F F |
| 09.76 | TRBV09*01 | TRBJ2-3*01 | TRBD1*01 | 866 | tgtgccagcagcgt..ca cc gggaca.... | ac ..cacagatacgcagtattt | | | | 2562 | C A S S V T G T T T D T Q Y F |
| 09.77 | TRBV09*01 | TRBJ1-3*01 | TRBD2*01 | 867 | tgtgccagcagcgta. accact | ........gggggg | ....ggaaacaccatatattt | | | 2563 | C A S S V T T G G G N T I Y F |
| 09.78 | TRBV09*01 | TRBJ2-1*01 | TRBD2*02 | 868 | tgtgccagcagcgtag ttccc | .......agcgga... | tgtatgg ........tgagcagttcttc | | | 2564 | C A S S V V P S G M Y G E Q F F |
| 09.79 | TRBV09*01 | TRBJ2-1*01 | TRBD2*02 | 869 | tgtgccagcagcgtag t ..gactagcgggagg. agg .tcctacaatgagcagttcttc | | | | | 2565 | C A S S V V T S G R R S Y N E Q F F |
| 09.80 | TRBV09*01 | TRBJ2-3*01 | | 870 | tgtgccagcagcgt..ctacgacg ..gcacagatacgcagtattt | | | | | 2566 | C A S S V Y D G T D T Q Y F |
| 09.81 | TRBV09*01 | TRBJ2-6*01 | TRBD2*01 | 871 | tgtgccagca......ccgccaa ...tagcg..... aaggctctac.... ..gggccaacgtcctgactttc | | | | | 2567 | C A S T A N S E G S Y G A N V L T F |
| 10.01 | TRBV10-3*01 | TRBJ2-1*01 | TRBD2*01 | 872 | tgtgccatcagtg....cc ..gacta....... ttcc ag ctcctacaatgagcagttcttc | | | | | 2568 | C A I S A D Y S S S Y N E Q F F |
| 10.02 | TRBV10-3*01 | TRBJ2-7*01 | TRBD2*02 | 873 | tgtgccatcagtgagtc a | ......gggag. ctcctacgagcagtactc | | | | 2569 | C A I S E G G S S Y E Q Y F |
| 10.03 | TRBV10-3*01 | TRBJ2-1*01 | TRBD1*01 | 874 | tgtgccatcagtgagtc ga | .....tagcgggg. t | .......caatgagcagttcttc | | | 2570 | C A I S E S I A G V N E Q F F |
| 10.04 | TRBV10-3*01 | TRBJ2-3*01 | TRBD2*01 | 875 | tgtgccatcagtgagtc acct | ........gggggg | ctcgaa. cacagatacgcagtattt | | | 2571 | C A I S E S P G G A R N T D T Q Y F |
| 10.05 | TRBV10-3*01 | TRBJ2-1*01 | TRBD1*01 | 876 | tgtgccatcagtg.... ggga..... tgtcga gaag ctcctacaatgagcagttcttc | | | | | 2572 | C A I S G D V E S S Y N E Q F F |
| 10.06 | TRBV10-3*01 | TRBJ2-1*01 | TRBD1*01 | 877 | tgtgccatcagtg.... gatcgc ..gacagc.... ag ......aatgagcagttcttc | | | | | 2573 | C A I S G S R Q E N E Q F F |
| 10.07 | TRBV10-3*01 | TRBJ2-3*01 | TRBD2*02 | 878 | tgtgccatcagt.... agc ...ctagcggag. a .....agatacgcagtattt | | | | | 2574 | C A I S L A G E D T Q Y F |
| 10.08 | TRBV10-1*01 | TRBJ2-7*01 | TRBD2*02 | 879 | tgcgccagcagtg... g gggactagcggga.... ..tacgagcagtactc | | | | | 2575 | C A S S G G L A G Y E Q Y F |
| 10.09 | TRBV10-3*02 | TRBJ2-7*01 | TRBD2*01 | 880 | tgtgcca....... caaagga ....cgggg... at tcctacgagcagtactc TRBJ2 | | | | | 2576 | C A T K D G D S Y E Q Y F |
| 10.10 | TRBV10-3*01 | TRBJ1-1*01 | TRBD1*01 | 881 | tgtgcca........ cc ...caggg ....cgggggag tgaacactgaagcttcttt | | | | | 2577 | C A T Q G G G V N T E A F F |
| 10.11 | TRBV10-3*01 | TRBJ2-1*01 | TRBD2*01 | 882 | tgtgcca...... ccgtct ...ctagcg..... agggcggcc ......ccggggagctgttttt | | | | | 2578 | C A T V S S E G G P G E L F F |
| 11.01 | TRBV11-3*01 | TRBJ2-5*01 | TRBD1*01 | 883 | tgtgcagca...... acttatggcct .....gggg. aaagcaa ...........tacttc | | | | | 2579 | C A S N L W P G E R Q Y F |
| 11.02 | TRBV11-3*01 | TRBJ2-1*01 | TRBD2*01 | 884 | tgtgccagcag...... aattct ggga........ ....tacaatgagcagttcttc | | | | | 2580 | C A S R I L G Y N E Q F F |
| 11.03 | TRBV11-2*01 | TRBJ2-1*01 | TRBD2*01 | 885 | tgtgccagcag....... ac ........cgggg. ......tacaatgagcagttcttc | | | | | 2581 | C A S R P G Y N E Q F F |
| 11.04 | TRBV11-2*01 | TRBJ1-1*01 | TRBD2*01 | 886 | tgtgccagcagcgtt.. tg ......adcg....... cactgaagcttcttt | | | | | 2582 | C A S S F E R T E A F F |

Figure 1-33

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 11.05 | TRBV11-2*01 | TRBJ2-1*01 | TRBD2*01 | 887 | tgtgccagcagctt... | cggt | .....gggg... | tg ....tacaatgagcagttcttc | | 2583 | C A S S F G G V Y N E Q F F |
| 11.06 | TRBV11-2*01 | TRBJ2-7*01 | TRBD1*01 | 888 | tgtgccagcagctt... | c | .....gggc | ag ....tacgagcagttcttc | | 2584 | C A S S F G G Q Y E Q Y F |
| 11.07 | TRBV11-3*01 | TRBJ2-1*01 | | 889 | tgtgccagcagct... | tagaag | | ......caatgagcagttcttc | | 2585 | C A S S F R S N E Q F F |
| 11.08 | TRBV11-2*01 | TRBJ2-2*01 | TRBD1*01 | 890 | tgtgccagcagc.... | ggccccc | ggacaggg... | at ....caccggggagctgtttt | | 2586 | C A S S G P R T G I T G E L F F |
| 11.09 | TRBV11-2*01 | TRBJ1-2*01 | TRBD1*01 | 891 | tgtgccagcagc.... | gggac.... | gggag | ctaactatgctacacctc | | 2587 | C A S S G T G A N Y G Y T F |
| 11.10 | TRBV11-2*01 | TRBJ2-4*01 | TRBD2*01 | 892 | tgtgccagcagc.... | atagt | ........cgggg..... | ....aaacattcagtactc | | 2588 | C A S S I V G G N I Q Y F |
| 11.11 | TRBV11-1*01 | TRBJ2-5*01 | TRBD1*01 | 893 | tgtgccagcagc..... | a | ....agggg... | a .......agaccccagcttc | | 2589 | C A S S K G K T Q Y F |
| 11.12 | TRBV11-2*01 | TRBJ1-6*01 | TRBD2*02 | 894 | tgtgccagcagcttag.. | ccc | ......cggga.... | agggagcatacga ........caccccctccacttc | | 2590 | C A S S L A P G R E H T T P L H F |
| 11.13 | TRBV11-2*01 | TRBJ1-1*01 | TRBD1*01 | 895 | tgtgccagcagctagc | g a | ggga....... | ......gaacactgaagcttcttt | | 2591 | C A S S L A R E N T E A F F |
| 11.14 | TRBV11-2*01 | TRBJ1-1*01 | TRBD1*01 | 896 | tgtgccagcagcttaga | cccc | ....cagg..... | ......gaacactgaagcttcttt | | 2592 | C A S S L D P Q G N T E A F F |
| 11.15 | TRBV11-2*01 | TRBJ2-3*01 | TRBD2*01 | 897 | tgtgccagcagcttaga | ct | .......cgg..... | ......gcacagatacgcagtattt | | 2593 | C A S S L D S G T D T Q Y F |
| 11.16 | TRBV11-2*01 | TRBJ1-5*01 | | 898 | tgtgccagcagcttaga t tacatg......... | | | cagcccccagcattt | | 2594 | C A S S L D Y M Q P Q H F |
| 11.17 | TRBV11-2*01 | TRBJ2-7*01 | TRBD2*01 | 899 | tgtgccagcagctag | ggcc | .......gcgg... | ta ..tcctacgagcagtactc | | 2595 | C A S S L E A A V S Y E Q Y F |
| 11.18 | TRBV11-2*01 | TRBJ2-1*01 | TRBD1*01 | 900 | tgtgccagcagctt...... | ........gggggc | ccgcgga | accaagagaccagtactc | | 2596 | C A S S L G A R G N Q E T Q Y F |
| 11.19 | TRBV11-2*01 | TRBJ2-7*01 | TRBD2*01 | 901 | tgtgccagcagcttag... | g | gggactagc..... | cga ....tacgagcagtactc | | 2597 | C A S S L G G L A R Y E Q Y F |
| 11.20 | TRBV11-3*01 | TRBJ2-3*01 | TRBD2*01 | 902 | tgtgccagcagc..... | ctc | .ggactagc..... | tg ...cagatacgcagtattt | | 2598 | C A S S L G L A A D T Q Y F |
| 11.21 | TRBV11-2*01 | TRBJ1-1*01 | TRBD1*01 | 903 | tgtgccagcagc..... | ctttt | ...acaggg..... | tgg .......tgaagcttcttt | | 2599 | C A S S L L Q G G E A F F |
| 11.22 | TRBV11-2*01 | TRBJ2-2*01 | TRBD1*01 | 904 | tgtgccagcagcta.. | c gggacag..... | | gaacaccgggagctgttttt | | 2600 | C A S S L R D R N T G E L F F |
| 11.23 | TRBV11-2*01 | TRBJ2-1*01 | TRBD2*02 | 905 | tgtgccagcagctag.. | ttgggacacc | .gactagcgggag... | agg ......caatgagcagttcttc | | 2601 | C A S S L V G T P T S G R G N E Q F F |
| 11.24 | TRBV11-2*01 | TRBJ2-1*01 | TRBD1*01 | 906 | tgtgccagcagctag.. | tcccagtc | ....caggggc | tat.....caatgagcagttcttc | | 2602 | C A S S L V P V Q G A I N E Q F F |
| 11.25 | TRBV11-2*01 | TRBJ2-7*01 | TRBD1*01 | 907 | tgtgccagcagc..... | at | ......ggggg. | tt tcctacgagcagtactc | | 2603 | C A S S M G V S Y E Q Y F |
| 11.26 | TRBV11-2*01 | TRBJ2-5*01 | TRBD1*01 | 908 | tgtgccagcagc..... | ccc | ggggagc..... | cctggt ccaagagaccagtactc | | 2604 | C A S S P G T A W V Q E T Q Y F |
| 11.27 | TRBV11-1*01 | TRBJ2-7*01 | TRBD2*02 | 909 | tgtgccagcagc..... | cga ..actagcgggag... | | tttcg ....acgagcagtactc | | 2605 | C A S S R T S G S F D E Q Y F |
| 11.28 | TRBV11-2*01 | TRBJ2-7*01 | TRBD1*01 | 910 | tgtgccagcagct.... | ccgc | .ggacag....... | tccagg .........gcagtactc | | 2606 | C A S S A D S P G Q Y F |
| 11.29 | TRBV11-1*01 | TRBJ2-1*01 | TRBD1*01 | 911 | tgtgccagcagct..... | cc | gggactagcg....... | cg ....tacaatgagcagttcttc | | 2607 | C A S S G T S A Y N E Q F F |
| 11.30 | TRBV11-3*01 | TRBJ2-1*01 | TRBD1*01 | 912 | tgtgccagcagct..... | cccgt | ......gggc | ccccgtaggtttgg......tgagcagttcttc | | 2608 | C A S S P V G P R R F G E Q F F |
| 11.31 | TRBV11-2*01 | TRBJ2-5*01 | TRBD2*02 | 913 | tgtgccacagct.... | cccctg | ....ctagcgggag... | tttt ccaagagaccagtactc | | 2609 | C A S S P W L A G V F Q E T Q Y F |
| 11.32 | TRBV11-2*01 | TRBJ2-1*01 | TRBD2*01 | 914 | tgtgccagcagc..... | acag cc | gggactag......... | agtg .......aatgagcagttcttc | | 2610 | C A S S T A G T R V N E Q F F |

Figure 1-34

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 11.33 | TRBV11-2*01 | TRBJ2-2*01 | TRBD1*01 | 915 | tgtgccagcagc | accgtccggcacgcgca | gacag | cgaacaccgggagctgtttt | | 2611 | C A S S T V R H A Q T A N T G E L F F |
| 11.34 | TRBV11-2*01 | TRBJ2-2*01 | TRBD1*01 | 916 | tgtgccagcagc | gt | tagc | cct | accgggagctgtttt | 2612 | C A S S V S P T G E L F F |
| 11.35 | TRBV11-2*01 | TRBJ2-3*01 | TRBD2*02 | 917 | tgtgccagcagct | | ggaggg gcg gcaacgatacgcagtacttc | | | 2613 | C A S S W R G G T D T Q Y F |
| 11.36 | TRBV11-2*01 | TRBJ2-5*01 | TRBD2*02 | 918 | tgtgccagcagct | at | gagg cctct | caagagaccagtacttc | | 2614 | C A S S Y E A S Q E T Q Y F |
| 11.37 | TRBV11-2*01 | TRBJ2-2*01 | TRBD2*01 | 919 | tgtgccagca | ccgttggcctac | cgggg | agcc | gtttt | 2615 | C A S T V G P T G E P F F |
| 12.01 | TRBV12-5*01 | TRBJ2-2*01 | TRBD2*01 | 920 | tgtgctagtg | ctttgggg | ctagcgg | cgg | accgggagctgtttt | 2616 | C A S A L G A S G R T G E L F F |
| 12.02 | TRBV12-4*01 | TRBJ1-1*01 | TRBD1*01 | 921 | tgtgccagc | gacag | actatgag | cactgaagcttctt | | 2617 | C A S D R T M S T E A F F |
| 12.03 | TRBV12-5*01 | TRBJ1-1*01 | TRBD1*01 | 922 | tgtg | cagc gacag | tcccc tgaacactgaagcttctt | | | 2618 | C A S D S P L N T E A F F |
| 12.04 | TRBV12-4*01 | TRBJ1-1*01 | TRBD1*01 | 923 | tgtgccagc | gacag | tact a tgaacactgaagcttctt | | | 2619 | C A S D S T M N T E A F F |
| 12.05 | TRBV12-4*01 | TRBJ2-1*01 | TRBD2*02 | 924 | tgtgccagc | gaaagtt | ctagcgggag | tga | ctacaatgagcagttcttc | 2620 | C A S E S S S G S D Y N E Q F F |
| 12.06 | TRBV12-4*01 | TRBJ2-1*01 | TRBD2*01 | 925 | tgtgccagc | ttcca | cgggg | tgcta | lacaatgagcagttcttc | 2621 | C A S F H G V L Y N E Q F F |
| 12.07 | TRBV12-4*01 | TRBJ2-1*01 | TRBD1*01 | 926 | tgtgccagc | gga gacag | tttaagg | | gagcagttcttc | 2622 | C A S G D S L R E Q F F |
| 12.08 | TRBV12-5*01 | TRBJ2-7*01 | | 927 | tgtgctagtagtggttgg | caaccaatc | cctacgagcagtacttc | | | 2623 | C A S G L A T N P Y E Q Y F |
| 12.09 | TRBV12-5*01 | TRBJ2-2*01 | TRBD1*01 | 928 | tgtgctagtagtggttggt ggct | ggggagctgtttt | | | | 2624 | C A S G L V A G E L F F |
| 12.10 | TRBV12-5*01 | TRBJ2-7*01 | TRBD1*01 | 929 | tgtgctagtagtggttggt t | caggg | aagtta | ctacgagcagtacttc | | 2625 | C A S G L V Q G S Y Y E Q Y F |
| 12.11 | TRBV12-4*01 | TRBJ1-2*01 | TRBD1*01 | 930 | tgtgccagc | ggc caggg | tag | ctatggctacacttc | | 2626 | C A S G Q G S Y G Y T F |
| 12.12 | TRBV12-4*01 | TRBJ2-7*01 | TRBD1*01 | 931 | tgtgccagc | gg caggg | aaaatgg | cgagcagtacttc | | 2627 | C A S G R E N G E Q Y F |
| 12.13 | TRBV12-4*01 | TRBJ2-5*01 | TRBD1*01 | 932 | tgtgccagca | aatcttttt | cagg ct | caagagaccagtacttc | | 2628 | C A S K S F F Q A Q E T Q Y F |
| 12.14 | TRBV12-3*01 | TRBJ2-7*01 | TRBD1*01 | 933 | tgtgccag | tctttattc | cagg | ctcccccct | cgagcagtacttc | 2629 | C A S L L F Q A P P V E Q Y F |
| 12.15 | TRBV12-3*01 | TRBJ2-3*01 | TRBD1*01 | 934 | tgtgccagca | acgaagaa | agggt | cagatacgcagtacttc | | 2630 | C A S N E E R A D T Q Y F |
| 12.16 | TRBV12-3*01 | TRBJ1-5*01 | TRBD1*01 | 935 | tgtgccagcag | gggacaggggc | tttg | cagcccagcattctt | | 2631 | C A S R G Q G A L Q P Q H F |
| 12.17 | TRBV12-4*01 | TRBJ2-1*01 | TRBD1*01 | 936 | tgtgccagcag | g gggacaggg | at | aatgagcagttctt | | 2632 | C A S R G T G D N E Q F F |
| 12.18 | TRBV12-4*01 | TRBJ2-1*01 | TRBD2*01 | 937 | tgtgccagcag | acccaagtt | tagcg | accccgggccaa | acaatgagcagttcttc | 2633 | C A S R P K F S D P G P N N E Q F F |
| 12.19 | TRBV12-3*01 | TRBJ1-1*01 | TRBD1*01 | 938 | tgtgccagcag | atccct c gggaca | ccactct | caatgagcagttcttc | | 2634 | C A S R S L G T P R L N E Q F F |
| 12.20 | TRBV12-4*01 | TRBJ2-4*01 | TRBD1*01 | 939 | tgtgccagcag | cgcco ggacag | t agccaaaaacattcagtacttc | | | 2635 | C A S S A R T V A K N I Q Y F |
| 12.21 | TRBV12-3*01 | TRBJ1-1*01 | TRBD1*01 | 940 | tgtgccagcagttt | cgc gggac | c | cactgaagcttctt | | 2636 | C A S S F A G P T E A F F |
| 12.22 | TRBV12-4*01 | TRBJ1-2*01 | TRBD1*01 | 941 | tgtgccagcagttt | t | ggggg aatcg | atgctacacctc | | 2637 | C A S S F G G I D G Y T F |

Figure 1-35

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 12.23 | TRBV12-4*01 | TRBJ2-1*01 | TRBD2*02 | 942 | tgtgccagcagttt... | ct ...tagcaggag. | cccg | ......caatgagcagttcttc | | 2638 | C A S S F L A G A G N E Q F F |
| 12.24 | TRBV12-3*01 | TRBJ2-1*01 | TRBD2*01 | 943 | tgtgccagcagttt... | tctcc ...ctagcg...... | ccctttggg... | atgagcagttcttc | | 2639 | C A S S F L P S A L W D E Q F |
| 12.25 | TRBV12-3*01 | TRBJ1-2*01 | TRBD1*01 | 944 | tgtgccagcagttt... | taggatcga ..gacaggg... | agglac... | ...ggctacaccttc | | 2640 | C A S S F R I E T G R Y G Y T F |
| 12.26 | TRBV12-4*01 | TRBJ2-5*01 | TRBD2*02 | 945 | tgtgccagcagttt... | ttctcgaggcggtgttggag... | gcggag.. accaag | ......actlc | | 2641 | C A S S F S R G G V G R R E T Q D F |
| 12.27 | TRBV12-3*01 | TRBJ1-2*01 | | 946 | tgtgccagcagttt... | ctcgacctgttcg g ctaactatggctacaccttc | | | | 2642 | C A S S F S T C S A N Y G Y T F |
| 12.28 | TRBV12-3*01 | TRBJ1-2*01 | TRBD1*01 | 947 | tgtgccagcag..... | cata ..acagg.... | agc | ...clatggctacaccttc | | 2643 | C A S S I T G A Y G Y T F |
| 12.29 | TRBV12-4*01 | TRBJ2-5*01 | TRBD1*01 | 948 | tgtgccagcag..... | caa ..ggacaggg.. | aag ..ccaagagaccagtactlc | | | 2644 | C A S S K D R G S Q E T Q Y F |
| 12.30 | TRBV12-3*01 | TRBJ2-1*01 | TRBD2*01 | 949 | tgtgccagcagttt... | g ......gcgg...... | ...cctacaatgagcagttcttc | | | 2645 | C A S S L A A Y N E Q F F |
| 12.31 | TRBV12-4*0 | TRBJ1-1*01 | TRBD1*01 | 950 | tgtgccagcagttag..... | ..aggggggc gcc ggg. | ..cactgaagcttcttt | | | 2646 | C A S S L E G A P G T E A F F |
| 12.32 | TRBV12-4*01 | TRBJ1-2*01 | TRBD1*01 | 951 | tgtgccagcagttag.. aact ..gacagg... | ......cccctc. | ......ggctacaccttc | | | 2647 | C A S S L E L T G P L G Y T F |
| 12.33 | TRBV12-4*01 | TRBJ1-5*01 | | 952 | tgtgccagcagttag. aa ...aatcagcccagcattt | | | | | 2648 | C A S S L E N Q P Q H F |
| 12.34 | TRBV12-3*01 | TRBJ2-7*01 | TRBD1*01 | 953 | tgtgccagcagtta... | ttctggctcccc.... ..gaca... | | ......agcagtactlc | | 2649 | C A S S L F W A P P D K Q Y F |
| 12.35 | TRBV12-3*01 | TRBJ2-7*01 | TRBD1*01 | 954 | tgtgccagcagtta... | ttct ........gggc | tcccccgt... | ..cgagcagtactlc | | 2650 | C A S S L F W A P P V E Q Y F |
| 12.36 | TRBV12-3*01 | TRBJ2-7*01 | TRBD2*01 | 955 | tgtgccagcagtta... | ttct ........gggg... | tcccccgtca... | ......agcagtactlc | | 2651 | C A S S L F W G P P V K Q Y F |
| 12.37 | TRBV12-4*01 | TRBJ2-5*01 | | 956 | tgtgccagcagttag. g ...agagaccagtactlc | | | | | 2652 | C A S S L G E T Q Y F |
| 12.38 | TRBV12-3*01 | TRBJ1-1*01 | | 957 | tgtgccagcagttt... | g ......ggggc ag ... | ...tgaagcttttt | | | 2653 | C A S S L G G S E A F F |
| 12.39 | TRBV12-4*01 | TRBJ2-1*01 | TRBD1*01 | 958 | tgtgccagcagtttag. ggt cc gggac... | ggccttggg ... | ......caatgagcagttcttc | | | 2654 | C A S S L G S G T A L G N E Q F F |
| 12.40 | TRBV12-3*01 | TRBJ1-1*01 | TRBD1*01 | 959 | tgtgccagcagttag... | g ....cag..... | cc tgaacactgaagctttctt | | | 2655 | C A S S L G S L N T E A F F |
| 12.41 | TRBV12-4*01 | TRBJ1-2*01 | TRBD2*02 | 960 | tgtgccagcagttag.. ggactagcgggag... | atggaatgaa ... | ......cagttcttc | | | 2656 | C A S S L G T S G R W N E Q F F |
| 12.42 | TRBV12-4*01 | TRBJ1-2*01 | TRBD1*01 | 961 | tgtgccagcagtta.. aatccct ...cagggg. | acct ...clatggctacaccttc | | | | 2657 | C A S S L N P S G D L Y G Y T F |
| 12.43 | TRBV12-3*01 | TRBJ2-7*01 | TRBD2*01 | 962 | tgtgccagcagtta. to ......ccggg... | aatt ..ctacgagcagtactlc | | | | 2658 | C A S S L S G E F Y E Q Y F |
| 12.44 | TRBV12-4*01 | TRBJ2-1*01 | TRBD2*02 | 963 | tgtgccagcagtta. tca ......ggagg. ta ..acgagcagtactlc | | | | | 2659 | C A S S L S G G N E Q Y F |
| 12.45 | TRBV12-4*01 | TRBJ2-1*01 | TRBD2*01 | 964 | tgtgccagcagtta. agtata ...agggggggg to ... | ......gagcagttcttc | | | | 2660 | C A S S L S I S G G V E Q F F |
| 12.46 | TRBV12-3*01 | TRBJ2-5*01 | TRBD2*02 | 965 | tgtgccagcagtta... | ac .....ccgga... | tcg accaagagaccagtactlc | | | 2661 | C A S S L T G I D Q E T Q Y F |
| 12.47 | TRBV12-3*01 | TRBJ2-5*01 | TRBD2*01 | 966 | tgtgccagcagtt... | gaccto .......ccggg... | ttggg ...gagaccagtactlc | | | 2662 | C A S S L T S G V G E T Q Y F |
| 12.48 | TRBV12-4*01 | TRBJ2-1*01 | TRBD2*01 | 967 | tgtgccagcagtta... | ..actacgg.... | ..ctacaatgagcagttcttc | | | 2663 | C A S S L T S G Y N E Q F F |
| 12.49 | TRBV12-4*01 | TRBJ2-1*01 | TRBD2*01 | 968 | tgtgccagcagtta. tg ......gcggggg. cgaa ......aatgagcagttcttc | | | | | 2664 | C A S S L V A G G E N E Q F F |
| 12.50 | TRBV12-4*01 | TRBJ2-7*01 | TRBD2*02 | 969 | tgtgccagcagtttag. t .......gggaggg a ...cctacgagcagtactlc | | | | | 2665 | C A S S L V G G T Y E Q Y F |

Figure 1-36

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 12.51 | TRBV12-3*01 | TRBJ2-1*01 | TRBD2*02 | 970 | tgtgccagcagt | ctgta | tagcgggagg | c | atgacagttcttc | 2666 | C A S S L Y S G R H E Q F F |
| 12.52 | TRBV12-4*01 | TRBJ2-2*01 | | 971 | tgtgccagcagt | cccg | ccggggagctgttttt | | | 2667 | C A S S P A G E L F F |
| 12.53 | TRBV12-4*01 | TRBJ2-1*01 | TRBD2*01 | 972 | tgtgccagcagt | cccatt | actag | agctcctg | acaatgagcagttcttc | 2668 | C A S S P I T R A P D N E Q F F |
| 12.54 | TRBV12-4*01 | TRBJ2-7*01 | TRBD1*01 | 973 | tgtgccagcag | ccct c | gggacaggg | tttt | tacgagcagtactc | 2669 | C A S S P R D R V F Y E Q Y F |
| 12.55 | TRBV12-4*01 | TRBJ2-3*01 | TRBD2*01 | 974 | tgtgccagcag | ccccc | ggactagcgg | tagaggg | acagatacgcagtatttt | 2670 | C A S S P R T S G R G T D T Q Y F |
| 12.56 | TRBV12-4*01 | TRBJ2-1*01 | TRBD2*01 | 975 | tgtgccagcag | cc | ctacgcgggg | at | tacaatgagcagttcttc | 2671 | C A S S P S G D Y N E Q F F |
| 12.57 | TRBV12-3*01 | TRBJ2-2*01 | TRBD1*01 | 976 | tgtgccagcagt | ccc | acaggg | | ccggggagctgtttt | 2672 | C A S S P T G A G E L F F |
| 12.58 | TRBV12-4*01 | TRBJ2-3*01 | TRBD1*01 | 977 | tgtgccagcag | cc | ggacagg | t | cagatacgcagtattt | 2673 | C A S S R T G S D T Q Y F |
| 12.59 | TRBV12-4*01 | TRBJ2-7*01 | TRBD1*01 | 978 | tgtgccagcagtt | c | gggc g gcg g ctcctacgagcagtactc | | | 2674 | C A S S G G G S Y E Q Y F |
| 12.60 | TRBV12-4*01 | TRBJ1-5*01 | TRBD1*01 | 979 | tgtgccagcagtt | ca | ggacagg | gcaatcagcccagcatttt | | 2675 | C A S S G Q G N Q P Q H F |
| 12.61 | TRBV12-4*01 | TRBJ2-7*01 | | 980 | tgtgccagcagtt | ctattgatgaatt | | | ctacgagcagtactc | 2676 | C A S S S I D G F Y E Q Y F |
| 12.62 | TRBV12-3*01 | TRBJ1-2*01 | TRBD1*01 | 981 | tgtgccagcagtt | ccccgatctatcga | ggacag | ct | taactatgctacacctc | 2677 | C A S S P I Y R G Q L N Y G Y T F |
| 12.63 | TRBV12-4*01 | TRBJ2-7*01 | TRBD1*01 | 982 | tgtgccagcagt | a cc gggac | cccact | ctacgagcagtactc | | 2678 | C A S S T G T P L Y E Q Y F |
| 12.64 | TRBV12-4*01 | TRBJ2-2*01 | TRBD2*02 | 983 | tgtgccagcagt | ac | actagcgggag | ttctc | acaccgggagctgttttt | 2679 | C A S S T L A G G S H T G E L F F |
| 12.65 | TRBV12-3*01 | TRBJ2-7*01 | TRBD2*01 | 984 | tgtgccagcagt | gtg | gcg | | tcctacgagcagttcttc | 2680 | C A S S V A S Y N E Q F F |
| 12.66 | TRBV12-4*01 | TRBJ1-1*01 | TRBD1*01 | 985 | tgtgccagcagtt | gggacctacacaggg aggttaggtg | | | gctttcttt | 2681 | C A S S W D L T G E G R V A F F |
| 12.67 | TRBV12-4*01 | TRBJ2-1*01 | TRBD2*02 | 986 | tgtgccagcagtt | ggactagcgggag | ctcggg | ctacaatgagcagttcttc | | 2682 | C A S S W T S G S S G Y N E Q F F |
| 12.68 | TRBV12-3*01 | TRBJ2-3*01 | TRBD2*02 | 987 | tgtgccagca | cgt | ctacgggaggg | atcg | agatacgcagtatttt | 2683 | C A S T S S G R D R D T Q Y F |
| 12.69 | TRBV12-3*01 | TRBJ2-5*01 | TRBD2*01 | 988 | tgtgcca | cctttgtaccca | cgggg | ttggg | gagaccagtacttc | 2684 | C A T L C T H G V G E T Q Y F |
| 12.70 | TRBV12-3*01 | TRBJ2-3*01 | TRBD2*01 | 989 | tgtg | gcatgagttgggggaatgaa | agcggggggcggggggatactct | | tattt | 2685 | C G M S S G E W K R G G R G D T S Y F |
| 13.01 | TRBV13*01 | TRBJ1-6*01 | TRBD1*01 | 990 | tgtgccagcag | acttacg gggac | cta | ctataattcaccctccactt | | 2686 | C A S R L T G T Y Y N S P L H F |
| 13.02 | TRBV13*01 | TRBJ2-1*01 | TRBD2*01 | 991 | tgtgccagcagctt | cgggg | agaggg | ctcctacaatgagcagttcttc | | 2687 | C A S S F G G E G S Y N E Q F F |
| 13.03 | TRBV13*01 | TRBJ2-2*01 | TRBD1*01 | 992 | tgtgccagcagctt | caggg | ctgtctactagga | | gagctgttttt | 2688 | C A S S F R A G L L G E L F F |
| 13.04 | TRBV13*01 | TRBJ2-5*01 | TRBD2*02 | 993 | tgtgccagcagctt | tagcgggag | tcagttataagaa | | agaccagtacttc | 2689 | C A S S F S G S Q F I R K T Q Y F |
| 13.05 | TRBV13*01 | TRBJ2-2*01 | TRBD2*01 | 994 | tgtgccagcagc | cac | ggactagcgggg | ct | caccggggagctgttttt | 2690 | C A S S H G L A G L T G E L F F |
| 13.06 | TRBV13*01 | TRBJ2-5*01 | TRBD1*01 | 995 | tgtgccagcagc | atccaaa | gggac | cag | gagaccagtactc | 2691 | C A S S I Q R D Q E T Q Y F |
| 13.07 | TRBV13*01 | TRBJ2-1*01 | TRBD2*01 | 996 | tgtgccagcagctag | ctg | ctacgggg | ccggc | gcagttcttc | 2692 | C A S S L A A S G P A Q F F |

Figure 1-37

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 13.08 | TRBV13*01 | TRBJ2-7*01 | TRBD2*02 | 997 | tgtgccagcagcttag | cgc | gcggag | aatcc | acgagcagtacttc | 2693 | C A S S L A R G R I H E Q Y F |
| 13.09 | TRBV13*01 | TRBJ2-7*01 | TRBD1*01 | 998 | tgtgccagcagcttag | a | aggg | ttgg | acgagcagtacttc | 2694 | C A S S L E G L D E Q Y F |
| 13.10 | TRBV13*01 | TRBJ2-1*01 | | 999 | tgtgccagcagcttagg | gggtg | | atgagcagttcttc | | 2695 | C A S S L G G D E Q F F |
| 13.11 | TRBV13*01 | TRBJ2-1*01 | TRBD2*01 | 1000 | tgtgccagcagcttagg | cc | ggactagcggg | cccctagg | atgagcagttcttc | 2696 | C A S S L G R T S G P P R D E Q F F |
| 13.12 | TRBV13*01 | TRBJ2-5*01 | TRBD2*01 | 1001 | tgtgccagcagcttagg | ggttggtgtcgat | ggg | | gagaccagtacttc | 2697 | C A S S L G V G V D G E T Q Y F |
| 13.13 | TRBV13*01 | TRBJ2-7*01 | TRBD2*01 | 1002 | tgtgccagcagcttagg | tta | cggg | tcaa | cctacgagcagtacttc | 2698 | C A S S L G Y G S T Y E Q Y F |
| 13.14 | TRBV13*01 | TRBJ2-7*01 | TRBD2*01 | 1003 | tgtgccagcagc | ctc | cgggg | | gagcagtacttc | 2699 | C A S S L R G E Q Y F |
| 13.15 | TRBV13*01 | TRBJ1-1*01 | TRBD2*01 | 1004 | tgtgccagcagcttag | tgct | gact | c | ctttcttt | 2700 | C A S S L V L T P F F |
| 13.16 | TRBV13*01 | TRBJ1-3*01 | TRBD1*01 | 1005 | tgtgccagcagcttag | t | gaca | ccg | ggaaacaccatatattt | 2701 | C A S S L V T P G N T I Y F |
| 13.17 | TRBV13*01 | TRBJ2-7*01 | TRBD2*01 | 1006 | tgtgccagcagctta | tg | gcgt | aa | ctctacgagcagtacttc | 2702 | C A S S L W R N S Y E Q Y F |
| 13.18 | TRBV13*01 | TRBJ1-6*01 | TRBD1*01 | 1007 | tgtgccagcagc | aa ccc | gggacagcag | ac | tcaccctcacttt | 2703 | C A S S N P G Q G D S P L H F |
| 13.19 | TRBV13*01 | TRBJ2-5*01 | TRBD1*01 | 1008 | tgtgccagcagc | cca c | gggacag | t | caagagaccagtacttc | 2704 | C A S S P R D S Q E T Q Y F |
| 13.20 | TRBV13*01 | TRBJ2-2*01 | TRBD1*01 | 1009 | tgtgccagcagc | cag | tgg | | accgggagctgtttt | 2705 | C A S S Q W T G E L F F |
| 13.21 | TRBV13*01 | TRBJ1-3*01 | TRBD1*01 | 1010 | tgtgccagcagc | cga | gga | ttcg | acaccatatattt | 2706 | C A S S R G F D T I Y F |
| 13.22 | TRBV13*01 | TRBJ2-3*01 | TRBD2*02 | 1011 | tgtgccagcagct | ctgataacccct | tagcaggag | aa | acagatacgcagtattt | 2707 | C A S S D N P L A G E T D T Q Y F |
| 13.23 | TRBV13*01 | TRBJ2-3*01 | TRBD2*01 | 1012 | tgtgccagcagct | cagacc | ggactag | tcatc | gcacagatacgcagtattc | 2708 | C A S S S D R T S H R T D T Q Y F |
| 13.24 | TRBV13*01 | TRBJ1-5*01 | TRBD2*02 | 1013 | tgtgccagcagct | ccggc | gaggg | | tcagcccccagcattt | 2709 | C A S S G E G Q P Q H F |
| 13.25 | TRBV13*01 | TRBJ2-3*01 | TRBD2*02 | 1014 | tgtgccagcagct | cccctttc | gaggg | aagg | gatacgcagtactlc | 2710 | C A S S S P F E G R D T Q Y F |
| 13.26 | TRBV13*01 | TRBJ2-7*01 | TRBD1*01 | 1015 | tgtgccagcagct | ccc | gggacagggg | aa | cctacgagcagtacttc | 2711 | C A S S S R D R G T Y E Q Y F |
| 13.27 | TRBV13*01 | TRBJ2-3*01 | TRBD1*01 | 1016 | tgtgccagcagct | c | cagggg | gccc | gcacagatacgcagtattt | 2712 | C A S S S R G A R T D T Q Y F |
| 14.01 | TRBV14*01 | TRBJ2-3*01 | TRBD1*01 | 1017 | tgtgcc | ccagccactccc | cagggg | aacgcac | tatttt | 2713 | C A P S H S P G G T H Y F |
| 14.02 | TRBV14*01 | TRBJ2-7*01 | TRBD1*01 | 1018 | tgtgccagcag | ggaacca | gggacagg | caaa | gagcagtacttc | 2714 | C A S R E P G T G K E Q Y F |
| 14.03 | TRBV14*01 | TRBJ2-1*01 | TRBD2*01 | 1019 | tgtgccagcag | gattt | caggggg | acta | aatgagcagttcttc | 2715 | C A S R I S G G L N E Q F F |
| 14.04 | TRBV14*01 | TRBJ2-3*01 | TRBD2*01 | 1020 | tgtgccagcagcca | cga cc | gggacta | cctttctggg | acagatacgcagtattt | 2716 | C A S S H D R D Y L S G T D T Q Y F |
| 14.05 | TRBV14*01 | TRBJ2-1*01 | TRBD2*01 | 1021 | tgtgccagcagc | tt | actagcggg | ctcctacaatgagcagttcttc | | 2717 | C A S S L L A G S Y N E Q F F |
| 14.06 | TRBV14*01 | TRBJ2-7*01 | | 1022 | tgtgccagcagccaaga tc | cctttcgtgtg g | ctcctacgagcagtacttc | | | 2718 | C A S S Q D P F R G G S Y E Q Y F |
| 14.07 | TRBV14*01 | TRBJ1-1*01 | TRBD2*01 | 1023 | tgtgccagcagccaaga | taggg | tagc | | gcagttcttc | 2719 | C A S S Q D R V A Q F F |

Figure 1-38

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 14.08 | TRBV14*01 | TRBJ2-1*01 | TRBD2*01 | 1024 | tgtgccagcagccaaga | ttacac | gactagc | agac | acaatgagcagttcttc | 2720 | C A S S Q D Y T T S R H N E Q F F |
| 14.09 | TRBV14*01 | TRBJ2-2*01 | TRBD2*01 | 1025 | tgtgccagcagccaaaga | agggg | agccgg | acccgaagggg | caccggggagctgtttt | 2721 | C A S S Q E G E R T R R G T G E L F F |
| 14.10 | TRBV14*01 | TRBJ2-5*01 | TRBD2*01 | 1026 | tgtgccagcagccaaga | gacc | ctagcggg | ttggt | accaagagaccagtactc | 2722 | C A S S Q E T L A G W Y Q E T Q Y F |
| 14.11 | TRBV14*01 | TRBJ2-5*01 | TRBD1*01 | 1027 | tgtgccagcagccaaga | at | ggggg | caaggagaccagtactc | | 2723 | C A S S Q E W G G A R T E A F F |
| 14.12 | TRBV14*01 | TRBJ1-1*01 | TRBD1*01 | 1028 | tgtgccagcagccaag | | ggc tcg | cactgaagcttcttt | | 2724 | C A S S Q G A R T E A F F |
| 14.13 | TRBV14*01 | TRBJ2-3*01 | TRBD2*02 | 1029 | tgtgccagcagccaag | gtgcc | agcgggaggg | cc aagg | gcacagatacgcagtattt | 2725 | C A S S Q G A S G R A K G T D T Q Y F |
| 14.14 | TRBV14*01 | TRBJ2-7*01 | TRBD2*02 | 1030 | tgtgccagcagcca | gggc | ctagcggag | ttac | ctcctacgagcagtactc | 2726 | C A S S Q G L A G V T S Y E Q Y F |
| 14.15 | TRBV14*01 | TRBJ2-7*01 | TRBD2*01 | 1031 | tgtgccagcagcagg | gc | cggg | taaa | gagcagtactc | 2727 | C A S S Q G R G K E Q Y F |
| 14.16 | TRBV14*01 | TRBJ2-2*01 | TRBD1*01 | 1032 | tgtgccagcagccaa | ccaactc | gacaggg | ac | cgaacaccgggagctgttttt | 2728 | C A S S Q P T R Q G P N T G E L F F |
| 14.17 | TRBV14*01 | TRBJ2-3*01 | TRBD1*01 | 1033 | tgtgccagcagcca | gtccc | cagggg | a | acgcagtattt | 2729 | C A S S Q S P G G T Q Y F |
| 14.18 | TRBV14*01 | TRBJ2-5*01 | TRBD2*01 | 1034 | tgtgccagc | te | gactagcgg | cc | accaagagaccagtactc | 2730 | C A S S T S G H Q E T Q Y F |
| 15.01 | TRBV15*01 | TRBJ2-5*01 | TRBD1*01 | 1035 | tgtgcca | t | acagggg | acctc | agagaccagtactc | 2731 | C A I Q G T S E T Q Y F |
| 15.02 | TRBV15*01 | TRBJ2-1*01 | TRBD2*01 | 1036 | tgtgccacc | ggac | ctgagccgtagtcg | | atgagcagttcttc | 2732 | C A T G P E R V V D E Q F F |
| 15.03 | TRBV15*02 | TRBJ2-1*01 | | 1037 | tgtg | ccaccgaaagcctaaacgaaacc | gag ctcctacaatgagcagtcttc | | | 2733 | C A T R K P N E P S S Y N E Q F F |
| 15.04 | TRBV15*02 | TRBJ2-1*01 | TRBD2*01 | 1038 | tgtg | ccaccagattaaaag | gcgg | | ctacaatgagcagttcttc | 2734 | C A T R L K G G Y N E Q F F |
| 15.05 | TRBV15*01 | TRBJ2-5*01 | TRBD2*02 | 1039 | tgtgccaccagc | gctcat | ggagg | | agagaccagtactc | 2735 | C A T S A H G G E T Q Y F |
| 15.06 | TRBV15*01 | TRBJ2-2*01 | TRBD1*01 | 1040 | tgtgccaccagc | gacga | gggacaggggc | gcg | caccggggagctgttttt | 2736 | C A T S D E G Q G A R T G E L F F |
| 15.07 | TRBV15*01 | TRBJ2-1*01 | TRBD2*02 | 1041 | tgtgccaccagca | ggactagcggga | ag | | gagcagttctc | 2737 | C A T S G L A G E E Q F F |
| 15.08 | TRBV15*01 | TRBJ2-2*01 | TRBD2*01 | 1042 | tgtgccaccagca | tagcaggtaccatgaacac | cgggg | agca | gttttt | 2738 | C A T S I A G T M N T G E Q F F |
| 15.09 | TRBV15*01 | TRBJ2-5*01 | TRBD2*01 | 1043 | tgtgccaccagca | tagtc | gcggg | cgagaacaattt | cttc | 2739 | C A T S I V A G E N N F F |
| 15.10 | TRBV15*02 | TRBJ2-1*01 | TRBD1*01 | 1044 | tgtg | ccaccagcaaagattac | acagg | ctcctacaatgagcagttcttc | | 2740 | C A T S K D Y T G S Y N E Q F F |
| 15.11 | TRBV15*01 | TRBJ2-1*01 | TRBD2*01 | 1045 | tgtg | ccaccagtcta | actagcggg | | tacaatgagcagttcttc | 2741 | C A T S L T S G Y N E Q F F |
| 15.12 | TRBV15*01 | TRBJ2-5*01 | TRBD2*01 | 1046 | tgtgccaccagca | accatg | gcgg | | agagaccagtactc | 2742 | C A T S N H G G E T Q Y F |
| 15.13 | TRBV15*01 | TRBJ2-7*01 | TRBD2*02 | 1047 | tgtgccaccagc | cccg | gcgggag | tctgag | ccgagcagtactc | 2743 | C A T S P G G S L S E Q Y F |
| 15.14 | TRBV15*01 | TRBJ2-5*01 | TRBD1*01 | 1048 | tgtgccaccag | cctc gggaca | ccgtacaagagaccaa | tacttc | | 2744 | C A T S P R D T V Q E T Q Y F |
| 15.15 | TRBV15*01 | TRBJ2-7*01 | TRBD2*01 | 1049 | tgtgccaccacag | g | gcgg | ccggg | tacgcagtactc | 2745 | C A T S R A A G Y E Q Y F |
| 15.16 | TRBV15*02 | TRBJ1-5*01 | TRBD1*01 | 1050 | tgtg | ccaccagcagag | cagggg | c | caatcagcccccagcagttt | 2746 | C A T S R A G A N Q P Q H F |

Figure 1-39

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 15.17 | TRBV15*02 | TRBJ2-1*01 | TRBD1*01 | 1051 | tgtg....... | ccaccagcagagcaa | .ggacagg... | cctt ....... | aatgagcagttcttc | 2747 | C A T S R A R T G L N E Q F F |
| 15.18 | TRBV15*02 | TRBJ2-7*01 | TRBD1*01 | 1052 | tgtg....... | ccaccagcagagatgcc | .ggacag...... | ............ | tacgagcagtactc | 2748 | C A T S R D A G Q Y E Q Y F |
| 15.19 | TRBV15*02 | TRBJ2-7*01 | TRBD2*02 | 1053 | tgtg....... | ccaccagcagagagat | gggactagcaggagg | ..... | tacgagcagtactc | 2749 | C A T S R D G T S G R Y E Q Y F |
| 15.20 | TRBV15*02 | TRBJ1-5*01 | | 1054 | tgtg....... | ccaccagcagagatcacgcagcttcttg | .........gcccccagcattt | | | 2750 | C A T S R D H A A S S W P Q H F |
| 15.21 | TRBV15*02 | TRBJ2-3*01 | TRBD2*02 | 1055 | tgtg....... | ccaccagcagagagatc | ..ctagcggaggg | ...cagatacgcagtatttt | | 2751 | C A T S R D P S G R A D T Q Y F |
| 15.22 | TRBV15*02 | TRBJ2-5*01 | TRBD1*01 | 1056 | tgtg....... | ccaccagcagagatcccag | ....cagg.... | cgaatt ...gagaccagtactc | | 2752 | C A T S R D P S R R I E T Q Y F |
| 15.23 | TRBV15*02 | TRBJ2-1*01 | TRBD1*01 | 1057 | tgtg....... | ccaccagcagca | gggacagggg.... | cg ....acaatgagcagttcttc | | 2753 | C A T S R D R G D N E Q F F |
| 15.24 | TRBV15*01 | TRBJ2-6*01 | TRBD1*01 | 1058 | tgtgccaccagcagcag... | gga ...acaggg... | ctctgggccaacgtcctgacttc | | | 2754 | C A T S R E Q Q S G A N V L T F |
| 15.25 | TRBV15*02 | TRBJ2-3*01 | TRBD1*01 | 1059 | tgtg....... | ccaccagcagagaaa cc | gggacagggg. | at ...cagatacgcagtattttt | | 2755 | C A T S R E T G T G G S D T Q Y F |
| 15.26 | TRBV15*02 | TRBJ1-1*01 | TRBD1*01 | 1060 | tgtg....... | ccaccagcagagagt | .....ggggg. taggaag | ...cactgaagcttcttt | | 2756 | C A T S R E V G V G S T E A F F |
| 15.27 | TRBV15*02 | TRBJ2-7*01 | TRBD2*02 | 1061 | tgtg....... | ccaccagcagaggagct | ..actagcgggag... | catc ....ggagcagtactc | | 2757 | C A T S R G E L L A G A S E Q Y F |
| 15.28 | TRBV15*02 | TRBJ2-5*01 | TRBD2*01 | 1062 | tgtg....... | ccaccagcagagggaaa | .........ggggggg. | .aagagaccagtactc | | 2758 | C A T S R G K G G E E T Q Y F |
| 15.29 | TRBV15*02 | TRBJ2-7*01 | TRBD1*01 | 1063 | tgtg....... | ccaccagcag | gggacagggggc g aga | ......gagcagtactc | | 2759 | C A T S R G Q G A R E Q Y F |
| 15.30 | TRBV15*02 | TRBJ2-1*01 | TRBD1*01 | 1064 | tgtg....... | ccaccagcag | gggacag.... | ctt ag ctcctacaatgagcagttcttc | | 2760 | C A T S R G Q L S S Y N E Q F F |
| 15.31 | TRBV15*01 | TRBJ1-5*01 | TRBD2*02 | 1065 | tgtgccaccagcagag. | .......ggagg gagagag | ....tcagcccagcatt | | | 2761 | C A T S R G R G E S Q P Q H F |
| 15.32 | TRBV15*01 | TRBJ2-3*01 | TRBD2*02 | 1066 | tgtgccaccagcagag. | .gtaca | ......gggagg. agaggg | ..acagatacgcagtatttt | | 2762 | C A T S R G T G R R G T D T Q Y F |
| 15.33 | TRBV15*01 | TRBJ2-1*01 | TRBD2*01 | 1067 | tgtgccaccagcagag. | ..ggactagcg... | c ........ | ......caatgagcagttcttc | | 2763 | C A T S R G T S A N E Q F F |
| 15.34 | TRBV15*01 | TRBJ2-7*01 | TRBD2*01 | 1068 | tgtg | ccaccagcagagcgt. | ..ctagcgg..... | atttc ctcctacgagcagtactc | | 2764 | C A T S R R L A D S S Y E Q Y F |
| 15.35 | TRBV15*02 | TRBJ2-7*01 | TRBD1*01 | 1069 | tgtg....... | ccaccagtagaa ..ggacag..... | ctc ..cctacgagcagtactc | | | 2765 | C A T S R R T A P Y E Q Y F |
| 15.36 | TRBV15*02 | TRBJ1-1*01 | TRBD2*02 | 1070 | tgtg....... | ccaccagcagcagatcat c | gggacag.... | tgg ...tacgagcagtactc | | 2766 | C A T S R S S G Q W Y E Q Y F |
| 15.37 | TRBV15*02 | TRBJ2-2*02 | TRBD2*01 | 1071 | tgtg....... | ccaccagcagagtttcc | ........ggag. | a ......tgaagcttcttt | | 2767 | C A T S R V S G D E A F F |
| 15.38 | TRBV15*02 | TRBJ2-5*01 | TRBD2*01 | 1072 | tgtgccaccag..... | tcggt .......ggggggg t | ....gagaccagtactc | | | 2768 | C A T S R W G G E T Q Y F |
| 15.39 | TRBV15*02 | TRBJ1-6*01 | TRBD2*02 | 1073 | tgtg....... | ccaccagccgatac | ...cggaag. agc. | ....aattcaccctccacttt | | 2769 | C A T S R Y R E S N S P L H F |
| 15.40 | TRBV15*01 | TRBJ2-3*01 | TRBD2*01 | 1074 | tgtgccaccagcag.. | cgcagca ...act........ | agcacagatacgcagtatttt | | | 2770 | C A T S S A A T S T D T Q Y F |
| 15.41 | TRBV15*02 | TRBJ2-7*01 | TRBD1*01 | 1075 | tgtg....... | ccaccagcagaca..... | ......tacgagcagtactc | | | 2771 | C A T S S F G T Q Y E Q Y F |
| 15.42 | TRBV15*02 | TRBJ2-5*01 | TRBD2*01 | 1076 | tgtg....... | ccaccagcagcca | ........cgggggg. | .agagaccagtactc | | 2772 | C A T S S H G G E T Q Y F |
| 15.43 | TRBV15*01 | TRBJ2-5*01 | TRBD1*01 | 1077 | tgtgccaccac...... | gtcatccacgg | ....cagggg ....... | gagaccagtactc | | 2773 | C A T S S T A G E T Q Y F |

Figure 1-40

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 15.44 | TRBV15*01 | TRBJ2-5*01 | TRBD2*01 | 1078 | tgtgccacagca... | ccgtc ......gcggg... | c ...gagaccagtactc | | | 2774 | C A T S T V A G E T Q Y F |
| 18.01 | TRBV18*01 | TRBJ2-5*01 | TRBD2*02 | 1079 | tgtgccagctcacc... c | ........gagg. tgag. | ccaaggagaccagtactc | | | 2775 | C A S S P E V S Q E T Q Y F |
| 18.02 | TRBV18*01 | TRBJ1-1*01 | TRBD1*01 | 1080 | tgtgccagctc... | ccc .....ggggc agg | gaaacactgaagcttctt | | | 2776 | C A S S P G A G N T E A F F |
| 18.03 | TRBV18*01 | TRBJ1-3*01 | TRBD1*01 | 1081 | tgtgccagctcacc... c | .......gggc agtcaggagagt...tgaaacaccatatattt | | | | 2777 | C A S S P G Q S G E F G N T I Y F |
| 18.04 | TRBV18*01 | TRBJ1-5*01 | TRBD1*01 | 1082 | tgtgccagctcacca... | ggg. tcggg ....tcagcccagcattt | | | | 2778 | C A S S P G S G Q P Q H F |
| 18.05 | TRBV18*01 | TRBJ1-3*01 | TRBD1*01 | 1083 | tgtgccagctcacc... | tccc ..gacagg.... agaa ..ctgaaacaccatatattt | | | | 2779 | C A S S P P D R R T G N T I Y F |
| 18.06 | TRBV18*01 | TRBJ1-6*01 | TRBD1*01 | 1084 | tgtgccagctcaccacc | ggt .......ggc ggcattagaa .......tcacccctccacttt | | | | 2780 | C A S S P P V A A L E S P L H F |
| 18.07 | TRBV18*01 | TRBJ2-1*01 | TRBD2*01 | 1085 | tgtgccagctcaccac. | gggac............. ggggc ......caatgagcagttcttc | | | | 2781 | C A S S P R D G A N E Q F F |
| 18.08 | TRBV18*01 | TRBJ2-6*01 | TRBD1*01 | 1086 | tgtgccagctcacc... | ggt ...acagggggc ctctggggccaacgtcctgactc | | | | 2782 | C A S S P V Q G A S G A N V L T F |
| 18.09 | TRBV18*01 | TRBJ2-2*01 | TRBD1*01 | 1087 | tgtgccagctcac... | aa .ggacaggg... ctc ...caccgggagctcttt | | | | 2783 | C A S S Q G G S T G E L F F |
| 18.10 | TRBV18*01 | TRBJ2-7*01 | TRBD1*01 | 1088 | tgtgccagctc...... | gcgtacc ......gggc ccgaatctc ..cctacgagcagtacttc | | | | 2784 | C A S S R T G P E S P Y E Q Y F |
| 18.11 | TRBV18*01 | TRBJ2-2*01 | TRBD2*01 | 1089 | tgtgccagctc...... | cc ..ggacta........ cgaacaccgggagagctgttt | | | | 2785 | C A S S R T T N T G E L F F |
| 19.01 | TRBV19*01 | TRBJ2-3*01 | TRBD1*01 | 1090 | tgtgccagt........ | gctgggggtcgg ....ctagcgg........ tgag ....agatacgcagtatt | | | | 2786 | C A S A G G R L A V R D T Q Y F |
| 19.02 | TRBV19*01 | TRBJ2-1*01 | TRBD1*01 | 1091 | tgtgccagt...... | cgaa ..gac....... caagt ...agatacgcagtattt | | | | 2787 | C A S E D Q V D T Q Y F |
| 19.03 | TRBV19*01 | TRBJ1-3*01 | TRBD1*01 | 1092 | tgtgccag....... | c ..ggacag.... aaaac ctctgaaacaccatatattt | | | | 2788 | C A S G Q K T S G N T I Y F |
| 19.04 | TRBV19*01 | TRBJ1-2*01 | TRBD2*01 | 1093 | tgtgccagt...... | gggt ........ cggg........ tggctacacctc | | | | 2789 | C A S G S G G Y T F |
| 19.05 | TRBV19*01 | TRBJ2-7*01 | TRBD1*01 | 1094 | tgtgccagt...... | gggacagg... ac ..cctacgagcagtactc | | | | 2790 | C A S G T G P Y E Q Y F |
| 19.06 | TRBV19*01 | TRBJ1-1*01 | TRBD1*01 | 1095 | tgtgccagt....... | catgg ....caggg... taggg ......actgaagcttctt | | | | 2791 | C A S H G R V G T E A F F |
| 19.07 | TRBV19*01 | TRBJ1-5*01 | TRBD1*01 | 1096 | tgtgccagta..... | t ...acaggggc tggg agcaatcagcccagcattt | | | | 2792 | C A S I Q G A G S N Q P Q H F |
| 19.08 | TRBV19*01 | TRBJ2-1*01 | TRBD2*02 | 1097 | tgtgccagt....... | ctagcggggagg c tt...... aatgagcagttcttc | | | | 2793 | C A S L A G G L N E Q F F |
| 19.09 | TRBV19*01 | TRBJ1-1*01 | TRBD1*01 | 1098 | tgtgccagta..... | tgattcctc ..gacaggggc cggg .....ctgaagcttctt | | | | 2794 | C A S M I P S T G G R A E A F F |
| 19.10 | TRBV19*01 | TRBJ2-1*01 | TRBD2*01 | 1099 | tgtgcc.......... | tccca gggactagc....... ag g ctcctacaatgagcagttctc | | | | 2795 | C A S Q G L A G S Y N E Q F F |
| 19.11 | TRBV19*01 | TRBJ2-7*01 | TRBD2*01 | 1100 | tgtgccag....... | c ........cgggg... aga ctcctacgagcagtactc | | | | 2796 | C A S R G D S Y E Q Y F |
| 19.12 | TRBV19*01 | TRBJ2-2*01 | | 1101 | tgtgccagtag..... | acactgcta ....accgggggagctgttt | | | | 2797 | C A S R H W L T G E L F F |
| 19.13 | TRBV19*01 | TRBJ2-1*01 | TRBD1*01 | 1102 | tgtgccagt........ | cgct ...caggg... cc ....caccgggggagctgttttt | | | | 2798 | C A S R S G P T G E L F F |
| 19.14 | TRBV19*01 | TRBJ2-7*01 | TRBD2*01 | 1103 | tgtgccagtag..... | gt ...ctagcggggg.. aacct ...ctacgagcagtactc | | | | 2799 | C A S R S S G G N L Y E Q Y F |
| 19.15 | TRBV19*01 | TRBJ1-5*01 | TRBD2*01 | 1104 | tgtgccag........ | c ........cggg... tagcagcata ...caatcagcccagcattt | | | | 2800 | C A S R V A A Y N Q P Q H F |

Figure 1-41

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 19.16 | TRBV19*01 | TRBJ2-1*01 | TRBD2*02 | 1105 | tgtgccagt... | cgag ... | tagcggaagg | c ...cctacaatgagcagttcttc | | 2801 | C A S R V A G G P Y N E Q F F |
| 19.17 | TRBV19*01 | TRBJ1-2*01 | TRBD1*01 | 1106 | tgtgccagtag... | cg cc | gggac... | ggcg ... | tatggctacacctc | 2802 | C A S S A G T A Y G Y T F |
| 19.18 | TRBV19*01 | TRBJ2-2*01 | TRBD2*01 | 1107 | tgtgccagtagt... | gccct ... | actagc... | ccct ... | gggagctgttttt | 2803 | C A S S A L L A P G E L F F |
| 19.19 | TRBV19*01 | TRBJ2-1*01 | TRBD2*02 | 1108 | tgtgccagtact... | gc ... | gactagcgggag.. | tggaa ... | ctacaatgagcagttcttc | 2804 | C A S S A T S G G N Y N E Q F F |
| 19.20 | TRBV19*01 | TRBJ2-2*01 | TRBD2*02 | 1109 | tgtgccagtag... | cttc ... | actagcgggag.. | tatatggg ... | ccgggagctgttttt | 2805 | C A S S F T S G S I W A G E L F F |
| 19.21 | TRBV19*01 | TRBJ2-3*01 | TRBD2*02 | 1110 | tgtgccagtag... | c | ggactagcggga... | tcctcccggg ... | cagatacgcagtattt | 2806 | C A S S G L A G S S R A D T Q Y F |
| 19.22 | TRBV19*01 | TRBJ2-3*01 | TRBD2*01 | 1111 | tgtgccagtag... | c | ggacta... | tcggatcctcccggcagatacgcat ... lattt | | 2807 | C A S S G L S G S S R A D T H Y F |
| 19.23 | TRBV19*01 | TRBJ2-2*01 | TRBD1*01 | 1112 | tgtgccagtagt... | ggaa ... | gacaggg... | aaa | gaacaccgggagctgttttt | 2808 | C A S S G R Q G K N T G E L F F |
| 19.24 | TRBV19*01 | TRBJ1-1*01 | TRBD1*01 | 1113 | tgtgccagtagtatag... | c | ggac... | cga ... | gaagctttctt | 2809 | C A S S I A D R E A F F |
| 19.25 | TRBV19*01 | TRBJ2-1*01 | TRBD2*01 | 1114 | tgtgccagtagtatag... | cggg... | t | ... | tacaatgagcagttcttc | 2810 | C A S S I A G Y N E Q F F |
| 19.26 | TRBV19*01 | TRBJ2-1*01 | TRBD2*01 | 1115 | tgtgccagtagtatag... | ctgt | gggacta... | aatgagcagttcttc | | 2811 | C A S S I A V G L N E Q F F |
| 19.27 | TRBV19*01 | TRBJ2-7*01 | TRBD2*02 | 1116 | tgtgccagtagtataga | tggcgg ... | agcaggg... | cgt ...ctacgagcagttcttc | | 2812 | C A S S I D G G A G V Y E Q Y F |
| 19.28 | TRBV19*01 | TRBJ2-1*01 | TRBD1*01 | 1117 | tgtgccagtagtat... | c | gaca... | aacc ... | caatgagcagttcttc | 2813 | C A S S I D K P N E Q F F |
| 19.29 | TRBV19*01 | TRBJ1-5*01 | TRBD1*01 | 1118 | tgtgccagtagtataga | ctc | ggac... | ct | ...caatcagcccagcattt | 2814 | C A S S I D S D L N Q P Q H F |
| 19.30 | TRBV19*01 | TRBJ2-1*01 | TRBD2*01 | 1119 | tgtgccagtagtataga | c | ...actagcgggag.. | ctcctacaatgagcagttcttc | | 2815 | C A S S I D T S G G S Y N E Q F F |
| 19.31 | TRBV19*01 | TRBJ2-5*01 | TRBD1*01 | 1120 | tgtgccagtagtataga | tt | ggacaggg... | tatttg ... | gagaccgagttactc | 2816 | C A S S I D W T G Y L E T Q Y F |
| 19.32 | TRBV19*01 | TRBJ2-7*01 | | 1121 | tgtgccagtagtat... | cttcttttg | g | ctcctacgagcagttcttc | | 2817 | C A S S I F F G S Y E Q Y F |
| 19.33 | TRBV19*01 | TRBJ2-7*01 | TRBD1*01 | 1122 | tgtgccagtagtat... | cttcggcg ... | cttcgggac... | agc... | agc... | actc | 2818 | C A S S I F G E Q H F |
| 19.34 | TRBV19*01 | TRBJ2-2*01 | TRBD1*01 | 1123 | tgtgccagtagtat... | tttt | gggaca... | agtt ...acacggggagctgttttt | | 2819 | C A S S I F G T S Y T G E L F F |
| 19.35 | TRBV19*01 | TRBJ2-7*01 | TRBD2*01 | 1124 | tgtgccagtagtatag... | gtg ... | ctagcggg... | tctttg ... | gagcagttcttc | 2820 | C A S S I G A S G S L E Q F F |
| 19.36 | TRBV19*01 | TRBJ2-3*01 | TRBD2*02 | 1125 | tgtgccagtagtatag... | g | gggactagcgggag.. | ... | cagatacgcagtattt | 2821 | C A S S I G G L A G A D T Q Y F |
| 19.37 | TRBV19*01 | TRBJ1-5*01 | TRBD1*01 | 1126 | tgtgccagtagtat... | ggggc | acctacg ... | gcaatcagcccagcattt | | 2822 | C A S S I G G T Y G N Q P Q H F |
| 19.38 | TRBV19*01 | TRBJ2-4*01 | TRBD1*01 | 1127 | tgtgccagtagtat... | ggcac ...acagg... | cgga ct agccaaaaacattcagttcttc | | | 2823 | C A S S I G H T G G L A K N I Q Y F |
| 19.39 | TRBV19*01 | TRBJ2-1*01 | TRBD1*01 | 1128 | tgtgccagtagtat... | t | ... | gggc agt ctctacaatgagcagttcttc | | 2824 | C A S S I G Q V S Y N E Q F F |
| 19.40 | TRBV19*01 | TRBJ1-2*01 | TRBD2*01 | 1129 | tgtgccagtagtatag... | ggt ... | cgggggg... | clattt ... | tatgctacacctc | 2825 | C A S S I G S G G Y F Y G Y T F |
| 19.41 | TRBV19*01 | TRBJ2-7*01 | TRBD1*01 | 1130 | tgtgccagtagtat... | c | gggacacgg... | tcctacgagcagttcttc | | 2826 | C A S S I G T G S Y E Q Y F |
| 19.42 | TRBV19*01 | TRBJ1-2*01 | | 1131 | tgtgccagtagtat... | cgg ...ctatgctacacctc | | | | 2827 | C A S S I G Y G Y T F |
| 19.43 | TRBV19*01 | TRBJ2-1*01 | TRBD2*01 | 1132 | tgtgccagtagtat... | tatttcggg | cc | ggac... | gct ...tacaatgagcagttcttc | 2828 | C A S S I I S G R D A Y N E Q F F |

Figure 1-42

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 19.44 | TRBV19*01 | TRBJ1-1*01 | TRBD1*01 | 1133 | tgtgccagtagtat... | taa...acaggggc | cggg | a | tgaacactgaagctttctt | 2829 | C A S S I K Q G A G M N T E A F F |
| 19.45 | TRBV19*01 | TRBJ1-2*01 | | 1134 | tgtgccagtagtat... | cctttt | | ......caatgagcagttcttc | | 2830 | C A S S I L F N E Q F F |
| 19.46 | TRBV19*01 | TRBJ2-1*01 | TRBD2*01 | 1135 | tgtgccagtagtat... | ctt...actagcg... | cg | ...tacaatgagcagttcttc | | 2831 | C A S S I L A A Y N E Q F F |
| 19.47 | TRBV19*01 | TRBJ2-1*01 | TRBD2*01 | 1136 | tgtgccagtagtat... | cttgtt | ggg... | to | ...acaatgagcagttcttc | 2832 | C A S S I L L G H N E Q F F |
| 19.48 | TRBV19*01 | TRBJ1-5*01 | | 1137 | tgtgccagtagtat... | ta | a | tagcaatcagcccagcatttt | | 2833 | C A S S I N S N Q P Q H F |
| 19.49 | TRBV19*01 | TRBJ2-5*01 | TRBD1*01 | 1138 | tgtgccagtagtata... | a | gggacag... | ...ccaagagaccccagtactc | | 2834 | C A S S I R D S Q E T Q Y F |
| 19.50 | TRBV19*01 | TRBJ1-5*01 | TRBD1*01 | 1139 | tgtgccagtagtat... | ct cc | gggacagg... | tct | ...aatcagcccagcatttt | 2835 | C A S S I S G T G S N Q P Q H F |
| 19.51 | TRBV19*01 | TRBJ2-7*01 | TRBD1*01 | 1140 | tgtgccagtagtata... | tcca | gggacagg... | cgcga | ......gagcagtactc | 2836 | C A S S I S R D R A R E Q Y F |
| 19.52 | TRBV19*01 | TRBJ2-7*01 | TRBD2*01 | 1141 | tgtgccagtag.tataacc... | agcgggg... | aacct | ...tacgagcagtactc | | 2837 | C A S S I T S G E P Y E Q Y F |
| 19.53 | TRBV19*01 | TRBJ1-5*01 | | 1142 | tgtgccagtagtatag.ttct..caatcagcccagcatttt | | | | | 2838 | C A S S I V L N Q P Q H F |
| 19.54 | TRBV19*01 | TRBJ2-7*01 | TRBD1*01 | 1143 | tgtgccagtagtat... | cgtcgta..gacag.... | tta | ...ctacgagcagtactc | | 2839 | C A S S I V V D S Y Y E Q Y F |
| 19.55 | TRBV19*01 | TRBJ1-5*01 | TRBD2*01 | 1144 | tgtgccagtagtat... | tt | ......gggggg | gggtacccaccccccaggt | ......tttt | 2840 | C A S S I W G G G T H P Q V F |
| 19.56 | TRBV19*01 | TRBJ2-7*01 | | 1145 | tgtgccagtagtat...ctgccctgccg...acgagcagtactc | | | | | 2841 | C A S S I W P A D E Q Y F |
| 19.57 | TRBV19*01 | TRBJ2-2*01 | TRBD1*01 | 1146 | tgtgccagtagt... | ...ctagcg... | tccgg | ......cggggagctgtttt | | 2842 | C A S S L A S G G E L F F |
| 19.58 | TRBV19*01 | TRBJ2-7*01 | TRBD2*01 | 1147 | tgtgccagtagt... | ctcct | ...cggggg... | a | .tcctacgagcagtactc | 2843 | C A S S L L G G S Y E Q Y F |
| 19.59 | TRBV19*01 | TRBJ2-7*01 | TRBD1*01 | 1148 | tgtgccagtagt... | ctacgatc... | caggg... | ag | ...tacgagcagtactc | 2844 | C A S S L R S R E Y E Q Y F |
| 19.60 | TRBV19*01 | TRBJ1-5*01 | TRBD1*01 | 1149 | tgtgccagtagt... | ggac... | caggc... | | cagcccagcatt | 2845 | C A S S M D P G Q P Q H F |
| 19.61 | TRBV19*01 | TRBJ1-5*01 | TRBD1*01 | 1150 | tgtgccagtagt... | gggat... | ggggg... | | agcccagcatt | 2846 | C A S S M G M G E P Q H F |
| 19.62 | TRBV19*01 | TRBJ2-3*01 | TRBD1*01 | 1151 | tgtgccagtagt... | gcttc | ...cagg... | | acagatacgcagtatttt | 2847 | C A S S M L P G T D T Q Y F |
| 19.63 | TRBV19*01 | TRBJ2-1*01 | TRBD2*01 | 1152 | tgtgccagtagtat... | ...gactagcggggg... | a | ag ctcctacaatgagcagttcttc | | 2848 | C A S S M T S G G S S Y N E Q F F |
| 19.64 | TRBV19*01 | TRBJ2-1*01 | TRBD2*01 | 1153 | tgtgccagtagtat... | ggtacgtctccgg | oggact... | ...ttga | ....acaatgagcagttcttc | 2849 | C A S S M V R L R G T L N N E Q F F |
| 19.65 | TRBV19*01 | TRBJ2-1*01 | | 1154 | tgtgccagtagtat... g | | | ...tacaatgagcagttcttc | | 2850 | C A S S M Y N E Q F F |
| 19.66 | TRBV19*01 | TRBJ2-1*01 | TRBD2*02 | 1155 | tgtgccagtagta... | atgct | ...ctagcgga... | cct | ...tacaatgagcagttcttc | 2851 | C A S S N A L A G P Y N E Q F F |
| 19.67 | TRBV19*01 | TRBJ2-1*01 | TRBD2*01 | 1156 | tgtgccagtagta... | a | ......cgggg... | cgatatgg | ......aatgagcagttcttc | 2852 | C A S S N G A I W N E Q F F |
| 19.68 | TRBV19*01 | TRBJ1-2*01 | TRBD1*01 | 1157 | tgtgccagtagt... | ...ccggca cc | gggacagggg... | aaag | ...atgctacacctc | 2853 | C A S S P A P G Q G K D G Y T F |
| 19.69 | TRBV19*01 | TRBJ2-1*01 | TRBD2*01 | 1158 | tgtgccagtagt... | cca | ggact... | caaaacggg | ........tgagcagttcttc | 2854 | C A S S P G L K T G E Q F F |
| 19.70 | TRBV19*01 | TRBJ1-5*01 | TRBD1*01 | 1159 | tgtgccagtag... | ccctata | gggacaggg... | aagt | ...tcagcccagcatttt | 2855 | C A S S P I G T G E V Q P Q H F |
| 19.71 | TRBV19*01 | TRBJ2-3*01 | TRBD2*01 | 1160 | tgtgccagtag...ccccc | ......cggggg | aggccag | ......gatacgcagtatttt | | 2856 | C A S S P P G G G Q D T Q Y F |

Figure 1-43

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 19.72 | TRBV19*01 | TRBJ2-1*01 | TRBD1*01 | 1161 | tgtgccagtagt | cccac | ggaca | ca ag ctcctacaatgagcagttcttc | | 2857 | C A S S P T D T S S Y N E Q F F |
| 19.73 | TRBV19*01 | TRBJ2-4*01 | TRBD1*01 | 1162 | tgtgccagtagt | ccctatc | gacagggg | agg | acattgactactc | 2858 | C A S S P Y R Q G E D I Q Y F |
| 19.74 | TRBV19*01 | TRBJ1-5*01 | TRBD1*01 | 1163 | tgtgccagtag | c | cagggg | tttacc | agcaatcagcccagcattt | 2859 | C A S S Q G F T S N Q P Q H F |
| 19.75 | TRBV19*01 | TRBJ1-6*01 | TRBD1*01 | 1164 | tgtgccag | cagtcag | caggg | cgg | taattcaccctccacttt | 2860 | C A S S Q Q G G N S P L H F |
| 19.76 | TRBV19*01 | TRBJ1-4*01 | TRBD1*01 | 1165 | tgtgccagtagt | ca | gacag | caactaatgaaaaactgttttt | | 2861 | C A S S Q T A T N E K L F F |
| 19.77 | TRBV19*01 | TRBJ2-3*01 | TRBD1*01 | 1166 | tgtgccagtagt | caaac | ggggc | g | gatacgcagtattt | 2862 | C A S S Q T G A D T Q Y F |
| 19.78 | TRBV19*01 | TRBJ2-7*01 | TRBD1*01 | 1167 | tgtgccagtag | cca | gacagggg | | ctacgagcagtactc | 2863 | C A S S Q T G G Y E Q Y F |
| 19.79 | TRBV19*01 | TRBJ2-3*01 | TRBD2*01 | 1168 | tgtgccagtag | cc | gggac | cctgggat | agatacgcagtattt | 2864 | C A S S R D P S G I D T Q Y F |
| 19.80 | TRBV19*01 | TRBJ2-7*01 | TRBD2*01 | 1169 | tgtgccagtagt | c | grcg | tttcagca | acgagcagtactc | 2865 | C A S S R G F S N E Q Y F |
| 19.81 | TRBV19*01 | TRBJ2-3*01 | TRBD2*01 | 1170 | tgtgccagtagt | c | gactaccg | attg | gcacagatacgcagtattt | 2866 | C A S S R L A I G T D T Q Y F |
| 19.82 | TRBV19*01 | TRBJ1-4*01 | TRBD1*01 | 1171 | tgtgccagtagt | tccgccgagg | aggg | cgtgggg | gaaaaactgttttt | 2867 | C A S S A E E G V G E K L F F |
| 19.83 | TRBV19*01 | TRBJ1-1*01 | TRBD1*01 | 1172 | tgtgccagtagt | tcgg | cagggg | gtcgag | cactgaagcttcttt | 2868 | C A S S A G G W S T E A F F |
| 19.84 | TRBV19*01 | TRBJ2-1*01 | TRBD1*01 | 1173 | tgtgccagtagt | tccgagtgtcgg | gggacagggggc | tacgcggcc | cctacaatgagcagttcttc | 2869 | C A S S E V W G D R G L A G P Y N E Q F F |
| 19.85 | TRBV19*01 | TRBJ2-7*01 | TRBD1*01 | 1174 | tgtgccagtagt | tcc | gacagg | tgag | ctacgagcagtactc | 2870 | C A S S R Q V S Y N E Q F F |
| 19.86 | TRBV19*01 | TRBJ2-7*01 | TRBD1*01 | 1175 | tgtgccagtagt | tcctcgt | cggacaggg | ta | tacaatgagcagttctc | 2871 | C A S S W D R V Y N E Q F F |
| 19.87 | TRBV19*01 | TRBJ2-2*01 | TRBD2*01 | 1176 | tgtgccagtagta | | cgg | | ccgggagctgtttt | 2872 | C A S S T A G E L F F |
| 19.88 | TRBV19*01 | TRBJ2-7*01 | TRBD2*01 | 1177 | tgtgccagtagta | c | agccgg | ttg | cctacgagcagtactc | 2873 | C A S S T A V A Y E Q Y F |
| 19.89 | TRBV19*01 | TRBJ2-2*01 | TRBD2*01 | 1178 | tgtgccagtagta | c | gggactacgcggag | tccgcg | ccggggagctgttttt | 2874 | C A S S T G L A G V R A G E L F F |
| 19.90 | TRBV19*01 | TRBJ2-1*01 | TRBD2*02 | 1179 | tgtgccagtagta | cccatgaa | ggactacgcggaggg | c aaggg | atgagcagttcttc | 2875 | C A S S T H E G L A G G G D E Q F F |
| 19.91 | TRBV19*01 | TRBJ2-2*01 | TRBD2*02 | 1180 | tgtgccagtagta | caaacgccgatgacct | caccgggagctgtttt | | | 2876 | C A S S T N A D D L T G E L F F |
| 19.92 | TRBV19*01 | TRBJ1-1*01 | TRBD1*01 | 1181 | tgtgccagtagt | gt gggacagggg | cgg | actgaagcttcttt | | | 2877 | C A S S V G Q G R T E A F F |
| 19.93 | TRBV19*01 | TRBJ2-7*01 | TRBD2*01 | 1182 | tgtgccagtagta | gtcc gggac | | ggaggta | cctacgagcagtactc | 2878 | C A S S V R D G G T Y E Q Y F |
| 19.94 | TRBV19*01 | TRBJ2-7*02 | TRBD2*02 | 1183 | tgtgccagta | caaa | cggga | tt | aacaccgggagctgttttt | 2879 | C A S T N G I N T G E L F F |
| 19.95 | TRBV19*01 | TRBJ2-2*01 | TRBD2*01 | 1184 | tgtgccagta | ctccgggagag gggactag | tcgt | accgggagctgtttt | | 2880 | C A S T P G E G T S R T G E L F F |
| 19.96 | TRBV19*01 | TRBJ2-7*01 | TRBD2*02 | 1185 | tgtgccagt | gttca | gggagg | cgagcagtg | ctc | 2881 | C A S V Q Q G E Q C F |
| 19.97 | TRBV19*01 | TRBJ2-7*01 | TRBD2*02 | 1186 | tgtgccagt | gttca | gggagg | cgagcagtactc | | 2882 | C A S V Q Q G E Q Y F |
| 19.98 | TRBV19*01 | TRBJ2-1*01 | TRBD2*01 | 1187 | tgtgccagt | tacggcccctgag | agcg | ag | ctacaatgagcagttcttc | 2883 | C A S Y G P W R A S Y N E Q F F |

Figure 1-44

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 19.99 | TRBV19*01 | TRBJ2-2*01 |  | 1188 | tgtgcca... | ctaagg... | ccgggagctgtttt |  |  | 2884 | C A T K A G E L F F |
| 20.001 | TRBV21-1*01 | TRBJ1-6*01 |  | 1189 | tgtgccagcagcaaa.. | tcccgagag | ...aattcaccctccactt |  |  | 2885 | C A S S K S R E N S P L H F |
| 20.002 | TRBV20-1*01 | TRBJ2-7*01 | TRBD1*01 | 1190 | tgcagtgct... | g ccc gggaca... | aactgccctactctgggt | ...tacgagcagtactc |  | 2886 | C S A A R D K L P L L W G Y E Q Y F |
| 20.003 | TRBV20-1*01 | TRBJ2-2*01 | TRBD1*01 | 1191 | tgcagtgct... | gacg | ...caggggc g | cgaacacgggagctgtttt |  | 2887 | C S A D A G G A N T G E L F F |
| 20.004 | TRBV20-1*01 | TRBJ2-1*01 | TRBD2*01 | 1192 | tgcagtgc... | ggataa ..gactag... | t ... | tacaatgagcagttcttc |  | 2888 | C S A D K T S Y N E Q F F |
| 20.005 | TRBV20-1*01 | TRBJ1-1*01 | TRBD1*01 | 1193 | tgcagtgc... | c ..gacagg... | aac | ...ctgaagcttcttt |  | 2889 | C S A D R E P E A F F |
| 20.006 | TRBV20-1*01 | TRBJ2-2*01 | TRBD1*01 | 1194 | tgcagtgct... | gac ...acaggggc g | cgaacacgggagctgtttt |  |  | 2890 | C S A D T G G A N T G E L F F |
| 20.007 | TRBV20-1*01 | TRBJ2-1*01 | TRBD2*01 | 1195 | tgcagtgc... | agac ...actacg... | tccc | ctcctacaatgagcagttcttc |  | 2891 | C S A D T S V P S Y N E Q F F |
| 20.008 | TRBV20-1*01 | TRBJ2-7*01 | TRBD1*01 | 1196 | tgcagtgct... | gaga cc gggaca..... | tctat | ......cgagcagtactc |  | 2892 | C S A E T G T S I E Q Y F |
| 20.009 | TRBV20-1*01 | TRBJ2-3*01 | TRBD2*02 | 1197 | tgcagtgct... | tttcccc | ...cgggagg.. cgggg .ccaagagaccagtactc | gatacgcagtattt |  | 2893 | C S A F P P G G P S D T Q Y F |
| 20.010 | TRBV20-1*01 | TRBJ2-5*01 | TRBD2*01 | 1198 | tgcagtgct... | gg ... | agcggggg... cggg ..ccaagagaccagtactc |  |  | 2894 | C S A G A G A G Q E T Q Y F |
| 20.011 | TRBV20-1*01 | TRBJ1-1*01 | TRBD1*01 | 1199 | tgcagtgct... | gggggt | gggacaggggc taaaggg.. | actgaagcttcttt |  | 2895 | C S A G G W D R G L K G T E A F F |
| 20.012 | TRBV20-1*01 | TRBJ2-3*01 | TRBD2*01 | 1200 | tgcagtgct... | gggattatgtac ..gactagc... | agca | agcacagatacgcagtattt |  | 2896 | C S A G I I V R L A A S T D T Q Y F |
| 20.013 | TRBV20-1*01 | TRBJ2-5*01 | TRBD1*01 | 1201 | tgcagtgc... | a ..ggacagggg.. gta | ...aagagaccagtactc |  |  | 2897 | C S A G Q Q G K E T Q Y F |
| 20.014 | TRBV20-1*01 | TRBJ1-5*01 | TRBD1*01 | 1202 | tgcagtgct... | cacgggg ...caggggg.. | agaggg | ....tcagcccccagcattt |  | 2898 | C S A H A A G G E G Q P Q H F |
| 20.015 | TRBV20-1*01 | TRBJ2-3*01 | TRBD2*02 | 1203 | tgcagtgcta... | ttg ...ctacgcggaggg cc ggcc.. | cagatacgcagtattt |  |  | 2899 | C S A I A S G R A G P D T Q Y F |
| 20.016 | TRBV20-1*01 | TRBJ2-7*01 | TRBD2*02 | 1204 | tgcagtgcta... | tc ... | gaggg c tcaggatgga | ....acgagcagtactc |  | 2900 | C S A I E G S G W N E Q Y F |
| 20.017 | TRBV20-1*01 | TRBJ2-5*01 | TRBD1*01 | 1205 | tgcagtgc... | gatacgg ...cagggggc cac | ....gagaccagtactc |  |  | 2901 | C S A I R A G G H E T Q Y F |
| 20.018 | TRBV20-1*01 | TRBJ2-3*01 | TRBD2*01 | 1206 | tgcagtgcta... | tcc ..ggactagcgggg.. | tgga | ....agatacgcagtattt |  | 2902 | C S A I R T S G V G D T Q Y F |
| 20.019 | TRBV20-1*01 | TRBJ2-6*01 | TRBD1*01 | 1207 | tgcagtgcta... | ttact cc gggaca.... | ccg | ctctggggccaacgtcctgacttc |  | 2903 | C S A I T P G H R S G A N V L T F |
| 20.020 | TRBV20-1*01 | TRBJ2-7*01 | TRBD1*01 | 1208 | tgcagtgc... | cctgg gggacagg... | acggga | ...tacgagcagtactc |  | 2904 | C S A L G D R T G Y E Q Y F |
| 20.021 | TRBV20-1*01 | TRBJ2-2*01 | TRBD2*02 | 1209 | tgcagtgc... | cctggggga ...actagcggga... | ttggc.. | ......gagcagttcttc |  | 2905 | C S A L G E L A G V G E Q F F |
| 20.022 | TRBV20-1*01 | TRBJ2-1*01 | TRBD1*01 | 1210 | tgcagtgc... | ctttt cc gggac... | gcctc | ..acaatgagcagttcttc |  | 2906 | C S A L S G T P H N E Q F F |
| 20.023 | TRBV20-1*01 | TRBJ1-2*01 | TRBD1*01 | 1211 | tgcagtgc... | cctcgtt ggga... | tcc | ...........acacctc |  | 2907 | C S A L V G I H T F |
| 20.024 | TRBV20-1*01 | TRBJ1-2*01 | TRBD1*01 | 1212 | tgcagtgcta... | atcct ...caggg...... | ctatgctacacctc |  |  | 2908 | C S A N P Q G Y G Y T F |
| 20.025 | TRBV20-1*01 | TRBJ1-1*01 | TRBD2*02 | 1213 | tgcagtgc... | caattc gggactagcggga... | aca | ......aatgagcagttcttc |  | 2909 | C S A N S G L A G T N E Q F F |
| 20.026 | TRBV20-1*01 | TRBJ2-5*01 | TRBD2*02 | 1214 | tgcagtgcta... | actctatg... | agcgggag.. t | ....gagaccagtactc |  | 2910 | C S A N S M S G S E T Q Y F |

Figure 1-45

| clone # | V name | J name | D name | SEQ ID NO: | V-REGION | N1 | D-REGION | (P) | N2 | J-REGION | SEQ ID NO: | CDR3 amino acid |
|---|---|---|---|---|---|---|---|---|---|---|---|---|
| 20.027 | TRBV20-1*01 | TRBJ2-1*01 | TRBD2*01 | 1215 | tgcagtgct | ccagcctc | actagcg | tccaacggg | g | ctcctacaatgagcagttcttc | 2911 | C S A P A S L A S Q R G S Y N E Q F F |
| 20.028 | TRBV20-1*01 | TRBJ1-5*01 | TRBD1*01 | 1216 | tgcagtgc | cccggga | gggacag | atcta | | aatcagcccagcattt | 2912 | C S A P G G T D L N Q P Q H F |
| 20.029 | TRBV20-1*01 | TRBJ2-2*01 | TRBD2*02 | 1217 | tgcagtgct | cctcttatc | cggaggg | ac | cggggagctgttttt | | 2913 | C S A P L I R E G P G E L F F |
| 20.030 | TRBV20-1*01 | TRBJ2-7*01 | TRBD1*01 | 1218 | tgcagtgct | ccgaacctaa | acagggg | gat | tacgagcagtactc | | 2914 | C S A P N L N R G D Y E Q Y F |
| 20.031 | TRBV20-1*02 | TRBJ1-5*01 | TRBD1*01 | 1219 | tgcagtgct ccgaacactgg | gggacagggg | cgttgg | agcaatcagcccagcatttt | | | 2915 | C S A P N T G G G R W S N Q P Q H F |
| 20.032 | TRBV20-1*01 | TRBJ2-7*01 | TRBD1*01 | 1220 | tgcagtgc | cccgac | ccggg | atgccagcaga | | agtactc | 2916 | C S A P T G D A S E K Y F |
| 20.033 | TRBV20-1*01 | TRBJ2-3*01 | TRBD2*02 | 1221 | tgcagtgc | ccctggg | ctagcgggag | cggggg | | acgcagtattt | 2917 | C S A P W A S G G S R G T Q Y F |
| 20.034 | TRBV20-1*01 | TRBJ1-4*01 | TRBD1*01 | 1222 | tgcagtgctagag | cccac | ggaca | tag | taatgaaaaactgtttt | | 2918 | C S A R A H G H S N E K L F F |
| 20.035 | TRBV20-1*01 | TRBJ2-7*01 | TRBD2*02 | 1223 | tgcagtgctagag | c | actagcgggag | ag | | tacgagcagtactc | 2919 | C S A R A L A G E Y E Q Y F |
| 20.036 | TRBV20-1*01 | TRBJ1-5*01 | TRBD2*01 | 1224 | tgcagtgctagag | cccta | gggggg | gtcagccccaa | | cattt | 2920 | C S A R A L G G G Q P Q H F |
| 20.037 | TRBV20-1*01 | TRBJ2-1*01 | TRBD1*01 | 1225 | tgcagtgctagaga | t ga c | gggactagc | c | acaatgagcagttcttc | | 2921 | C S A R D D G T S H N E Q F F |
| 20.038 | TRBV20-1*01 | TRBJ1-1*01 | TRBD1*01 | 1226 | tgcagtgctagaga | tgataagggg | | cggggg | | atgagcagttcttc | 2922 | C S A R D D D K G P G D E Q F F |
| 20.039 | TRBV20-1*01 | TRBJ2-7*01 | TRBD1*01 | 1227 | tgcagtgctagaga t ga | gggact | | cctg | tcctacgagcagtactc | | 2923 | C S A R D E G L L S Y E Q Y F |
| 20.040 | TRBV20-1*01 | TRBJ2-1*01 | TRBD2*02 | 1228 | tgcagtgctagaga | tgag | gttgag | aga | ctacaatgagcagttcttc | | 2924 | C S A R D E G R D Y N E Q F F |
| 20.041 | TRBV20-1*01 | TRBJ2-1*01 | TRBD2*02 | 1229 | tgcagtgctagaga t ttcg | gccggag | aaggc | ctcctacaatgagcagttcttc | | | 2925 | C S A R D F G G G R R A S Y N E Q F F |
| 20.042 | TRBV20-1*01 | TRBJ2-1*01 | | 1230 | tgcagtgctagaga t ttaacctcgtc | | | | caatgagcagttctc | | 2926 | C S A R D F T S S N E Q F F |
| 20.043 | TRBV20-1*01 | TRBJ1-2*01 | TRBD1*01 | 1231 | tgcagtgctagaga t ggga | | | ta | tacaatgagcagttcttc | | 2927 | C S A R D G I Y N E Q F F |
| 20.044 | TRBV20-1*01 | TRBJ2-2*01 | | 1232 | tgcagtgctagaga cgga | | | | aacaccgggagctgttttt | | 2928 | C S A R D G N T G E L F F |
| 20.045 | TRBV20-1*01 | TRBJ2-2*02 | TRBD2*02 | 1233 | tgcagtgctagaga t ggg | agcgga | t | gaacaccgggagctgttttt | | | 2929 | C S A R D G S G M N T G E L F F |
| 20.046 | TRBV20-1*01 | TRBJ1-2*01 | TRBD1*01 | 1234 | tgcagtgctag | gga c gggacagg | | a | atgctacacttc | | 2930 | C S A R D G T G N G Y T F |
| 20.047 | TRBV20-1*01 | TRBJ1-5*01 | TRBD1*01 | 1235 | tgcagtgc | aagaga c gggaca | | cattatagcaatcagcccagcatttt | | | 2931 | C S A R D G T H Y S N Q P Q H F |
| 20.048 | TRBV20-1*01 | TRBJ2-1*01 | TRBD2*02 | 1236 | tgcagtgctagaga | tcac | ctagcggg | tgcctt | caatgagcagttcttc | | 2932 | C S A R D H L A G A F N E Q F F |
| 20.049 | TRBV20-1*01 | TRBJ2-3*01 | TRBD2*01 | 1237 | tgcagtgctagaga tct | cggggg | tttaa | agatacgcagtattt | | | 2933 | C S A R D L G G F K D T Q Y F |
| 20.050 | TRBV20-1*01 | TRBJ2-2*01 | TRBD1*01 | 1238 | tgcagtgctagaga tct | gggg | | | accgggagctgttttt | | 2934 | C S A R D L G T G E L F F |
| 20.051 | TRBV20-1*01 | TRBJ1-4*01 | | 1239 | tgcagtgctagaga tct tggc | | | actaatgaaaaactgtttt | | | 2935 | C S A R D L G T N E K L F F |
| 20.052 | TRBV20-1*01 | TRBJ1-4*01 | TRBD1*01 | 1240 | tgcagtgctag | ggaca | acatag | caactaatgaaaaactgtttt | | | 2936 | C S A R D N I A T N E K L F F |
| 20.053 | TRBV20-1*01 | TRBJ2-2*01 | TRBD2*01 | 1241 | tgcagtgct cgaagccc | agcgg | | cgaaccgggagctgttttt | | | 2937 | C S A R D P A A N T G E L F F |
| 20.054 | TRBV20-1*02 | TRBJ2-7*01 | TRBD1*01 | 1242 | tgcagtgct cgagaccc | gacagg | ct | ctacgagcagtactc | | | 2938 | C S A R D P D R L Y E Q Y F |

Figure 1-46

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 20.055 | TRBV20-1*01 | TRBJ2-1*01 | TRBD2*02 | 1243 | tgcagtgctagaga | tcccggg | ...ctagcggga... | agggaatgggtgag | ..........gcagttcttc | 2939 | C S A R D P G L A G R E W V R Q F F |
| 20.056 | TRBV20-1*01 | TRBJ2-1*01 | TRBD2*01 | 1244 | tgcagtgctagaga | tc cgactgcga | c gggactagcgg.... | a  ...ctacaatgagcagttcttc | | 2940 | C S A R D P T A T G L A D Y N E Q F F |
| 20.057 | TRBV20-1*06 | TRBJ2-7*01 | TRBD2*02 | 1245 | tgcagtgct | ag agatccatatgc | ...actagcgggga... | at ..ctacgagcagtactc | | 2941 | C S A R D P Y A L A G I Y E Q Y F |
| 20.058 | TRBV20-1*01 | TRBJ2-7*01 | TRBD1*01 | 1246 | tgcagtgctagaga | cca ..gacaggg.. | attttgtgaa.......... | cagtactc | | 2942 | C S A R D Q T G I F G E Q Y F |
| 20.059 | TRBV20-1*01 | TRBJ2-3*01 | TRBD1*01 | 1247 | tgcagtgctagaa | taggga ....agggg. | agaggt ....agatacgcag | | | 2943 | C S A R D R E G G E V D T Q Y F |
| 20.060 | TRBV20-1*01 | TRBJ2-7*01 | TRBD1*01 | 1248 | tgcagtgctagaga | ....cagg.... | cctca ctcctacgagcagtactc | | | 2944 | C S A R D R P H S Y E Q Y F |
| 20.061 | TRBV20-1*01 | TRBJ1-2*01 | TRBD1*01 | 1249 | tgcagtgctagaa | tc gg .....agggggc | ...actatgctacacctc | | | 2945 | C S A R D R R G H Y G Y T F |
| 20.062 | TRBV20-1*01 | TRBJ1-5*01 | TRBD1*01 | 1250 | tgcagtgctagaga | tcg ....cagg..... | cgtat ..caatcagcccagcattt | | | 2946 | C S A R D R R R I N Q P Q H F |
| 20.063 | TRBV20-1*02 | TRBJ2-7*01 | TRBD2*02 | 1251 | tgcagtgct ag agatc | .......ggag.. | ctcctacgagcagtactc | | | 2947 | C S A R D R S S Y E Q Y F |
| 20.064 | TRBV20-1*01 | TRBJ2-7*01 | TRBD2*01 | 1252 | tgcagtgctagaa | .......tagcgggg... | ccg ..cctacgagcagtactc | | | 2948 | C S A R D S G A A Y E Q Y F |
| 20.065 | TRBV20-1*01 | TRBJ1-5*01 | | 1253 | tgcagtgctagaga | t accccctcgg | ..gcaatcagcccagcattt | | | 2949 | C S A R D T P S G N Q P Q H F |
| 20.066 | TRBV20-1*01 | TRBJ2-5*01 | TRBD2*02 | 1254 | tgcagtgctagaa | t gtt ....ctagcggga... | aagatg ......gagacccagtactc | | | 2950 | C S A R D V L A G K M E T Q Y F |
| 20.067 | TRBV20-1*01 | TRBJ2-7*01 | TRBD1*01 | 1255 | tgcagtgctagaga | t t gggacag... | ctcctacgagcagtactc | | | 2951 | C S A R D W D S S Y E Q Y F |
| 20.068 | TRBV20-1*01 | TRBJ2-3*01 | TRBD1*01 | 1256 | tgcagtgctagaa | ag gggacaggg.. | atacg ......gatacgcagtattt | | | 2952 | C S A R E G D R D T D T Q Y F |
| 20.069 | TRBV20-1*01 | TRBJ2-7*01 | TRBD1*01 | 1257 | tgcagtgctagaa | ..gacaggg.. | ta ..ctacgagcagtactc | | | 2953 | C S A R E T G Y Y E Q Y F |
| 20.070 | TRBV20-1*01 | TRBJ2-5*01 | TRBD2*02 | 1258 | tgcagtgctag... | gtt....tagcgggagg | cc accagatg..caagagaccagtactc | | | 2954 | C S A R F S G R A T Q M Q E T Q Y F |
| 20.071 | TRBV20-1*01 | TRBJ2-5*01 | TRBD1*01 | 1259 | tgcagtgct.... | cga ....gggc g g | cttggt accaagagaccagtactc | | | 2955 | C S A R G A A W Y Q E T Q Y F |
| 20.072 | TRBV20-1*01 | TRBJ1-1*01 | TRBD2*02 | 1260 | tgcagtgctagag. | g ...agcaggag.. | tacc ......caatgagcagttcttc | | | 2956 | C S A R G A G V P N E Q F F |
| 20.073 | TRBV20-1*01 | TRBJ1-6*0 | TRBD1*01 | 1261 | tgcagtgctagag. | g ........agggg | ........taattcaccctcact | | | 2957 | C S A R G G G N S P L H F |
| 20.074 | TRBV20-1*01 | TRBJ2-3*01 | TRBD1*01 | 1262 | tgcagtgctagag. | gggggt ....tagcggg... | c .gcacagatacgcagtattt | | | 2958 | C S A R G G V S G R T D T Q Y F |
| 20.075 | TRBV20-1*01 | TRBJ2-7*01 | TRBD2*02 | 1263 | tgcagtgctag... | gggta .....agcggga... | ...ctacgagcagtactc | | | 2959 | C S A R G K R D Y E Q Y F |
| 20.076 | TRBV20-1*01 | TRBJ2-7*01 | TRBD1*01 | 1264 | tgcagtgctag... | ........gggggc | tccggacga ctcctacgagcagtactc | | | 2960 | C S A R G L R D D S Y E Q Y F |
| 20.077 | TRBV20-1*01 | TRBJ2-7*01 | TRBD2*01 | 1265 | tgcagtgctagag. | gcat ggacta..... | tct ctcctacgagcagtactc | | | 2961 | C S A R G M D Y L S Y E Q Y F |
| 20.078 | TRBV20-1*01 | TRBJ2-7*01 | TRBD2*01 | 1266 | tgcagtgctag.... | gggtc ...ctagcg..... | tt tcctacgagcagtactc | | | 2962 | C S A R G P S V S Y E Q Y F |
| 20.079 | TRBV20-1*01 | TRBJ2-7*01 | TRBD1*01 | 1267 | tgcagtgctag.... | ..gacag... | tgggct ag ctcctacgagcagtactc | | | 2963 | C S A R G Q W A S S Y E Q Y F |
| 20.080 | TRBV20-1*02 | TRBJ2-7*01 | TRBD1*01 | 1268 | tgcagtgct ag a | gggacag.... | cggag ...tacgagcagtactc | | | 2964 | C S A R G T A E Y E Q Y F |
| 20.081 | TRBV20-1*01 | TRBJ2-5*01 | TRBD1*01 | 1269 | tgcagtc..... | aa ..gaca...... | cacgagctt ..ccaagagaccagtactc | | | 2965 | C S A R H T S F Q E T Q Y F |
| 20.082 | TRBV20-1*01 | TRBJ2-7*01 | TRBD2*01 | 1270 | tgcagtgctaga. | a .....tagcggg... | cgtcg ...cctacgagcagtactc | | | 2966 | C S A R I A G V A Y E Q Y F |

Figure 1-47

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 20.083 | TRBV20-1*01 | TRBJ1-1*01 | TRBD2*02 | 1271 | tgaagtgctaga.. | atcctttt | .......gaagg.. | ......tgaagcttcttt | | 2967 | C S A R I L L E G E A F F |
| 20.084 | TRBV20-1*01 | TRBJ2-3*01 | TRBD2*02 | 1272 | tgcagtgctaga.. | aagctgggtattgag | ......gatacgcagtattt | | | 2968 | C S A R K L G I E D T Q Y F |
| 20.085 | TRBV20-1*01 | TRBJ2-2*01 | TRBD2*02 | 1273 | tgcagtgctaga.. | ...ctacgcggaag.. | ....acaccgggagctgttttt | | | 2969 | C S A R L A G D T G E L F F |
| 20.086 | TRBV20-1*01 | TRBJ2-1*01 | TRBD2*01 | 1274 | tgcagtgctag.. | gctcg | ....agcgggggg.. | .....acaatgagcagtcttc | | 2970 | C S A R L E R G D N E Q F F |
| 20.087 | TRBV20-1*01 | TRBJ2-7*01 | TRBD1*01 | 1275 | tgcagtgc.. | ....ccgtttga | gggaca.. | ......cctacgagcagtactc | | 2971 | C S A R L R D T Y E Q Y F |
| 20.088 | TRBV20-1*06 | TRBJ2-2*01 | TRBD2*02 | 1276 | tgcagtgc.. | gagaat | gggactagccggaag.. | ..acaccgggagctgttttt | | 2972 | C S A R M G L A G D T G E L F F |
| 20.089 | TRBV20-1*01 | TRBJ2-1*01 | TRBD1*01 | 1277 | tgcagtgc.. | ....ccgcaatgggagccc | ......ggggc c | .....caatgagcagtcttc | | 2973 | C S A R N G E P G P N E Q F F |
| 20.090 | TRBV20-1*01 | TRBJ2-1*01 | TRBD2*01 | 1278 | tgcagtgctaga.. | aa cc | gggac.. | ...........ggggg ..cctacaatgagcagtcttc | | 2974 | C S A R N R D G A Y N E Q F F |
| 20.091 | TRBV20-1*01 | TRBJ2-7*01 | TRBD2*01 | 1279 | tgcagtgc.. | ....ccggc | ......cggggg.. | .......ctacgagcagtactc | | 2975 | C S A R P G G Y E Q Y F |
| 20.092 | TRBV20-1*01 | TRBJ1-5*01 | TRBD1*01 | 1280 | tgcagtgctaga.. | ....caggg.. | tttag..gcaatcagcccagcattt | | | 2976 | C S A R Q G L G N Q P Q H F |
| 20.093 | TRBV20-1*01 | TRBJ2-3*01 | TRBD2*02 | 1281 | tgcagtgc.. | ....ccgaag.. | .....agcgggag.. | .....cagatacgcagtattt | | 2977 | C S A R R A G A D T Q Y F |
| 20.094 | TRBV20-1*01 | TRBJ2-7*01 | TRBD1*01 | 1282 | tgcagtgct.. | cgac ..gacaggg.. | atccgct ..tacgagcagtactc | | | 2978 | C S A R R Q G S A Y E Q Y F |
| 20.095 | TRBV20-1*01 | TRBJ2-7*01 | TRBD2*01 | 1283 | tgcagtgctag.. | gagta ..gga.. | .........cctacgagcagtactc | | | 2979 | C S A R S R T Y E Q Y F |
| 20.096 | TRBV20-1*01 | TRBJ1-5*01 | TRBD1*01 | 1284 | tgcagtgc.. | .....cagg.. | accgactgatattgg | ........agccccagcattt | | 2980 | C S A R T R L I L E P Q H F |
| 20.097 | TRBV20-1*01 | TRBJ2-1*01 | TRBD1*01 | 1285 | tgcagtgc.. | ......cc | ggactagccgggg.. | ....at | ......aatgagcagttcttc | 2981 | C S A R T S G D N E Q F F |
| 20.098 | TRBV20-1*01 | TRBJ2-7*01 | TRBD2*02 | 1286 | tgcagtgctaga.. | acc | ......agcgggag.. | aggactggggg.. | .....cgagcagtactc | 2982 | C S A R T S G R G L G G E Q Y F |
| 20.099 | TRBV20-1*01 | TRBJ2-1*01 | TRBD2*02 | 1287 | tgcagtgc.. | ......aa | ggactagccgggagg.. | ttaaatcccg.. | ......atgagcagttcttc | 2983 | C S A R T S G R L N P D E Q F F |
| 20.100 | TRBV20-1*01 | TRBJ2-1*01 | TRBD1*01 | 1288 | tcg | ....cagggg.. | ccgggagt | ....cagatacgcagtattt | | 2984 | C S A R V A G A G E S D T Q Y F |
| 20.101 | TRBV20-1*01 | TRBJ2-3*01 | TRBD1*01 | 1289 | tgcagtgctagag.. | tcct ..gga.. | .......... t | .....tacgagcagtactc | | 2985 | C S A R V L D Y E Q Y F |
| 20.102 | TRBV20-1*01 | TRBJ2-7*01 | TRBD1*01 | 1290 | tgcagtgctagag.. | ta cc gggacag.. | ......aa ..ctacgagcagtactc | | | 2986 | C S A R V P G Q N Y E Q Y F |
| 20.103 | TRBV20-1*01 | TRBJ2-7*01 | TRBD1*01 | 1291 | tgcagtgctagag.. | tccctccaga ..gacaggg.. | acttaca ..cctacgagcagtactc | | | 2987 | C S A R V P P E T G T Y T Y E Q Y F |
| 20.104 | TRBV20-1*01 | TRBJ2-5*01 | TRBD2*01 | 1292 | tgcagtgctag.. | ggtc | ....cgggagg.. cg | .....gagaccagtactc | | 2988 | C S A R V R E A E T Q Y F |
| 20.105 | TRBV20-1*01 | TRBJ2-1*01 | TRBD2*02 | 1293 | tgcagtgctag.. | tt | ......cgggaggg cc tcag | .....caatgagcagtcttc | | 2989 | C S A R V R E G L S N E Q F F |
| 20.106 | TRBV20-1*01 | TRBJ2-7*01 | TRBD1*01 | 1294 | tgcagtgctag.. | tgc ..ggacaggg.. | ttctgtcg ...cgagcagtactc | | | 2990 | C S A R V A D R G S G R E Q Y F |
| 20.107 | TRBV20-1*01 | TRBJ2-1*01 | TRBD2*01 | 1295 | tgcagtgctag.. | cgc | ........cgggg.. | .......tgagcagttcttc | | 2991 | C S A S A G G E Q F F |
| 20.108 | TRBV20-1*01 | TRBJ1-5*01 | TRBD2*01 | 1296 | tgcagtgctag.. | ....t | .......gcgggggg accggtcatcat.. | ......cccagcatttt | | 2992 | C S A S A G G T G H H P Q H F |
| 20.109 | TRBV20-1*01 | TRBJ1-5*01 | TRBD2*01 | 1297 | tgcagtgctag.. | ....t | .......gcgggggg accggtcatcaaccccagtt | ......ttt | | 2993 | C S A S A G G T G H Q P Q F F |
| 20.110 | TRBV20-1*01 | TRBJ1-5*01 | TRBD2*01 | 1298 | tgcagtgctag.. | .....t | .......gcgggggg accggtc.. | .....atcagcccagcatttt | | 2994 | C S A S A G G T G H Q P Q H F |

Figure 1-48

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 20.111 | TRBV20-1*01 | TRBJ2-7*01 | TRBD2*01 | 1299 | tgcagtgctag... | tg ccc | gggac......... | ggatta. | cctacgagcagttcttc | 2995 | C S A S A R D G F T Y E Q Y F |
| 20.112 | TRBV20-1*01 | TRBJ2-3*01 | TRBD2*02 | 1300 | tgcagtgctag... | tgat .. | ctagcgggag..... | aaac... | cacagataccgcagttcttc | 2996 | C S A S D L A G E T T D T Q Y F |
| 20.113 | TRBV20-1*01 | TRBJ2-7*01 | TRBD2*01 | 1301 | tgcagtgct.... | t ....... | cggggg.. cagggataagctcctacgagcagttcttc | | | 2997 | C S A S G A G I S S Y E Q Y F |
| 20.114 | TRBV20-1*01 | TRBJ2-4*01 | TRBD1*01 | 1302 | tgcagtgctag... | cggt ... | ggggc aggtcat ..ccaaaaacattcagttactc | | | 2998 | C S A S G G A G S S K N I Q Y F |
| 20.115 | TRBV20-1*01 | TRBJ2-1*01 | TRBD2*02 | 1303 | tgcagtgctag.. | tgg | gggactagcgggagg. | aagta ..cctacaatgagcagttcttc | | 2999 | C S A S G G L A G G S T Y N E Q F F |
| 20.116 | TRBV20-1*01 | TRBJ2-7*01 | TRBD2*01 | 1304 | tgcagtgctag... | c ..ggactagcgg..... | a | ctcctacgagcagtactc | | 3000 | C S A S G L A D S Y E Q Y F |
| 20.117 | TRBV20-1*01 | TRBJ2-5*01 | TRBD2*02 | 1305 | tgcagtgctag.. | t ........ | gggag.. t ..caagagacccagtactc | | | 3001 | C S A S G S Q E T Q Y F |
| 20.118 | TRBV20-1*01 | TRBJ1-1*01 | TRBD1*01 | 1306 | tgcagtgc...... | ct cc gggacagggg.. tttctgg | | ......... agcttctt | | 3002 | C S A S G T G V S G A F F |
| 20.119 | TRBV20-1*01 | TRBJ2-7*01 | TRBD2*01 | 1307 | tgcagtgctag... | tcatggatc....... | cggg... | ttca..cctacgagcagtactc | | 3003 | C S A S H G S G F T Y E Q Y F |
| 20.120 | TRBV20-1*01 | TRBJ2-1*01 | TRBD1*01 | 1308 | tgcagtgc...... | ctcaaagtc........ | gggc tatccaccag ... | tgagcagcttctt | | 3004 | C S A S K S G Y P P S E Q F F |
| 20.121 | TRBV20-1*01 | TRBJ1-1*01 | TRBD1*01 | 1309 | tgcagtgctag... | cc ...cagggg.. ttgggg ... | acactgaagcttcttt | | | 3005 | C S A S P G V G D T E A F F |
| 20.122 | TRBV20-1*01 | TRBJ1-2*01 | TRBD2*02 | 1310 | tgcagtgc....... | atccctaacgatgactgg .... | aggg.. cgtttgg ..... | tggctacacctc | | 3006 | C S A S P N D D W R A F G G Y T F |
| 20.123 | TRBV20-1*01 | TRBJ1-1*01 | TRBD1*01 | 1311 | tgcagtgctag.. | tccca ....... | ggaaggg gt tgaacactgaagcttcttt | | | 3007 | C S A S P R E G L N T E A F F |
| 20.124 | TRBV20-1*01 | TRBJ2-1*01 | TRBD1*01 | 1312 | tgcagtgct ag tccctggcga tcctacaatgagcagttcttc | | | | | 3008 | C S A S P W R S Y N E Q F F |
| 20.125 | TRBV20-1*01 | TRBJ2-3*01 | TRBD1*01 | 1313 | tgcagtgctag... | cagg.... | aagtgactc agcacagataccgcagtatttt | | | 3009 | C S A S R K V L S T D T Q Y F |
| 20.126 | TRBV20-1*01 | TRBJ1-5*01 | TRBD1*01 | 1314 | tgcagtgctag... | tagt..gacag.... ttactt tagcaatcagcccccagcatttt | | | | 3010 | C S A S S D S Y F S N Q P Q H F |
| 20.127 | TRBV20-1*01 | TRBJ2-1*01 | TRBD2*02 | 1315 | tgcagtgctag... | tacaattgt gggactagcgggag.. cat ....... atgagcagttcttc | | | | 3011 | C S A S T I V G L A G A Y E Q F F |
| 20.128 | TRBV20-1*01 | TRBJ2-3*01 | TRBD2*01 | 1316 | tgcagtgc...... | ctcgaccc...gactacgcggggg.. acagatacc......... cagtatttt | | | | 3012 | C S A S T P T S G G T D T Q Y F |
| 20.129 | TRBV20-1*01 | TRBJ2-7*01 | TRBD1*01 | 1317 | tgcagtgc...... | cagcactcaccgtg ... ggggg ttag ....acgagcagtactc | | | | 3013 | C S A S T S P V G G L D E Q Y F |
| 20.130 | TRBV20-1*01 | TRBJ2-5*01 | TRBD2*02 | 1318 | tgcagtgct a cagaaa cc gggactagcgggag. ttggaagagcctgtg ...gagaccccagtact | | | | | 3014 | C S A T E T G T S G S W E E P V E T Q Y F |
| 20.131 | TRBV20-1*01 | TRBJ1-6*02 | TRBD2*01 | 1319 | tgcagtgcta... | c ...... | cggggg.... aa ag | ctcctataattcaccccctccactt | | 3015 | C S A T G E S S Y N S P L H F |
| 20.132 | TRBV20-1*01 | TRBJ2-1*01 | TRBD1*01 | 1320 | tgcagtgc...... | c ...acaggg... actcttaggcg ....... atgagcagttcttc | | | | 3016 | C S A T G T L S D E Q F F |
| 20.133 | TRBV20-1*01 | TRBJ2-1*01 | TRBD2*01 | 1321 | tgcagtgcta... | ccc .......cggggggg cc gagctcctacaatgagcagttcttc | | | | 3017 | C S A T P G G P S S Y N E Q F F |
| 20.134 | TRBV20-1*01 | TRBJ2-7*01 | TRBD1*01 | 1322 | tgcagtgc...... | aaccaccacatcgac....acagg.... tcc ..cctacgagcagtactc | | | | 3018 | C S A T P T S T Q V P Y E Q Y F |
| 20.135 | TRBV20-1*01 | TRBJ2-7*01 | TRBD1*01 | 1323 | tgcagtgcta... | cccaacga .. tcctacgagcagtactc | | | | 3019 | C S A T Q R S Y E Q Y F |
| 20.136 | TRBV20-1*01 | TRBJ2-7*01 | TRBD2*01 | 1324 | tgcagtgcta... | cctccgggacga ...... | cggggg. | ..cctacgagcagtactc | | 3020 | C S A T S G T T G A Y E Q Y F |
| 20.137 | TRBV20-1*01 | TRBJ2-7*01 | TRBD1*01 | 1325 | tgcagtgc...... | aaccagcccctaggagcc ...ctag........ aggatagg ....... gagcagtactc | | | | 3021 | C S A T S P L G A L E D R E Q Y F |
| 20.138 | TRBV20-1*01 | TRBJ2-7*01 | TRBD1*01 | 1326 | tgcagtgc...... | aac ...gacta........ agcccc ... acgagcagtactc | | | | 3022 | C S A T T K P H E Q Y F |

Figure 1-49

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 20.139 | TRBV20-1*01 | TRBJ2-5*01 | TRBD2*01 | 1327 | tgcagtgct | gtgggct | ggggg | aagagacccagtactc | | 3023 | C S A V G L E E T Q Y F |
| 20.140 | TRBV20-1*01 | TRBJ2-1*01 | TRBD1*01 | 1328 | tgcagtgc | ctggggccat | caggggc cggacatgc | | tgagcagttcttc | 3024 | C S A W G H Q G A G H A E Q F F |
| 20.141 | TRBV20-1*01 | TRBJ2-1*01 | TRBD1*01 | 1329 | tgcagtgc | gtggaga gggacaggggc | cctactagtcgc | | gagcagttcttc | 3025 | C S A W R G T G G P T S R E Q F F |
| 20.142 | TRBV20-1*01 | TRBJ2-7*01 | TRBD2*02 | 1330 | tgcagt | tgtgaggggaga gggagactagcgggaggg ag | cgagcagtactc | | | 3026 | C S C E G E G L A G G S E Q Y F |
| 20.143 | TRBV20-1*01 | TRBJ2-5*01 | | 1331 | tgcagtg | accccagcag | agagacccagtactc | | | 3027 | C S D P S R E T Q Y F |
| 20.144 | TRBV20-1*01 | TRBJ2-5*01 | TRBD2*01 | 1332 | tgcagtg | g | agcgggg | aggcgtact caagagaccagtactc | | 3028 | C S G A G R R T Q E T Q Y F |
| 20.145 | TRBV20-1*01 | TRBJ2-5*01 | TRBD1*01 | 1333 | tgcagtg | gaaggagc | caggg cctccg | agagacccagtactc | | 3029 | C S G R S Q G L R E T Q Y F |
| 20.146 | TRBV20-1*02 | TRBJ2-1*01 | TRBD1*01 | 1334 | tgcagt | tccct gggac | gaaa ctacaatgagcagttctc | | | 3030 | C S S L G R N Y N E Q F F |
| 20.147 | TRBV20-1*01 | TRBJ2-7*01 | TRBD2*02 | 1335 | tgcag | cacaccaggg | gcgggagg ttca | gagcagtactc | | 3031 | C S S T P G A G G S E Q Y F |
| 20.148 | TRBV20-1*01 | TRBJ2-4*01 | TRBD1*01 | 1336 | tgcagtg | tctatcaccctcctcatttgt | aaacattcagtactc | | | 3032 | C S V L S P S S F V N I Q Y F |
| 20.149 | TRBV20-1*01 | TRBJ2-1*01 | | 1337 | tgca | ctaccaaggctaagctt | caggg | tgagcagttcttc | | 3033 | C T T K A K L Q G E Q F F |
| 23.01 | TRBV23-1*01 | TRBJ1-2*01 | TRBD2*01 | 1338 | tgcgccagcag | cttcaataattccaagt | cgggggg c ga | ggctacaccttc | | 3034 | C A S S F N N S R S G G R G Y T F |
| 23.02 | TRBV23-1*01 | TRBJ2-7*01 | TRBD1*01 | 1339 | tgcgccagcagtca | tcc gggacag | ccgatca | cctacgagcagtactc | | 3035 | C A S S H P G Q P I T Y E Q Y F |
| 23.03 | TRBV23-1*01 | TRBJ2-1*01 | TRBD1*01 | 1340 | tgcgccagcagt | tca ggacaggggc | ca | actgaagcagttcttt | | 3036 | C A S S H Q D R G P T E A F F |
| 23.04 | TRBV23-1*01 | TRBJ2-4*01 | TRBD2*01 | 1341 | tgcgccagcag | ccctc | cggggg tacg | agccaaaaacattcagtactc | | 3037 | C A S S P P P G V R A K N I Q Y F |
| 23.05 | TRBV23-1*01 | TRBJ2-6*01 | TRBD1*01 | 1342 | tgcgccagcagtcaa | c ggacag | aa tctgggccaacgtcctgacttc | | | 3038 | C A S S Q R T E S G A N V L T F |
| 23.06 | TRBV23-1*01 | TRBJ2-2*01 | TRBD2*02 | 1343 | tgcgccagcagtcaatc ga ccttc | actagcgggag tcatactact | ggggagctgttttt | | | 3039 | C A S S Q S T F T S G S H T T G E L F F |
| 24.01 | TRBV24-1*01 | TRBJ2-2*01 | TRBD2*02 | 1344 | tgtgccac | ggtgatcccga | agggcagaaa | aacaccggggagctgttttt | | 3040 | C A T G D P E G Q K N T G E L F F |
| 24.02 | TRBV24-1*01 | TRBJ2-7*01 | TRBD2*01 | 1345 | tgtgccacc | ggtagt ggga | acgagcagtactc | | | 3041 | C A T G S G N E Q Y F |
| 24.03 | TRBV24-1*01 | TRBJ2-1*01 | TRBD2*02 | 1346 | tgtgccacca | tatcc | agcgggag ctctacaagatgagcagttctc | | | 3042 | C A T I S S G S S Y N E Q F F |
| 24.04 | TRBV24-1*01 | TRBJ1-1*01 | TRBD1*01 | 1347 | tgtgccacca | tg gggacaggggg | tgaagctttcttt | | | 3043 | C A T M G T G G E A F F |
| 24.05 | TRBV24-1*01 | TRBJ2-1*01 | TRBD1*01 | 1348 | tgtgccacca | t gacagtg | aatgagcagttcttc | | | 3044 | C A T M T G N E Q F F |
| 24.06 | TRBV24-1*01 | TRBJ2-2*01 | TRBD2*02 | 1349 | tgtgccaccag | gacga | tagcggggag acc cctacaatgagcagtttttt | | | 3045 | C A T R T I A G D P Y N E Q F F |
| 24.07 | TRBV24-1*01 | TRBJ2-1*01 | TRBD2*01 | 1350 | tgtgccaccagtg | cggggg | ccggggagctgtttt | | | 3046 | C A T S A G A G E L F F |
| 24.08 | TRBV24-1*01 | TRBJ2-5*01 | TRBD2*01 | 1351 | tgtgccaccagtg | ccc | cggggggg tacggc | gagacccagtactc | | 3047 | C A T S A P G G Y G E T Q Y F |
| 24.09 | TRBV24-1*01 | TRBJ2-1*01 | TRBD1*01 | 1352 | tgtgccaccagtgatt | caggg | agac | gagcagttcttc | | 3048 | C A T S D F R G D E Q F F |
| 24.10 | TRBV24-1*01 | TRBJ2-2*01 | TRBD1*01 | 1353 | tgtgccaccagtgattt | tc ggacagggg | at | accgggggagctgttttt | | 3049 | C A T S D F R T G D T G E L F F |

Figure 1-50

| clone # | V name | J name | D name | SEQ ID NO: | V-REGION N1 D-REGION (P) N2 J-REGION | SEQ ID NO: | CDR3 amino acid |
|---|---|---|---|---|---|---|---|
| 24.11 | TRBV24-1*01 | TRBJ2-5*01 | TRBD1*01 | 1354 | tgtgccaccagtga....cct..ggacag...taga..caagggaccagtactc | 3050 | C A T S D L D S R Q E T Q Y F |
| 24.12 | TRBV24-1*01 | TRBJ1-3*01 | TRBD1*01 | 1355 | tgtgccaccagtgattg..ccgg.....agggg..tcgaa...tggaacaccatatattt | 3051 | C A T S D L P E G S N G N T I Y F |
| 24.13 | TRBV24-1*01 | TRBJ1-5*01 | TRBD1*01 | 1356 | tgtgccaccagtgatt...acaggg..ag....ataagcccagcattt | 3052 | C A T S D L Q G D Q P Q H F |
| 24.14 | TRBV24-1*01 | TRBJ2-2*01 | TRBD2*02 | 1357 | tgtgccaccagtgatttg ca g....ctagcgggagg..ttctgac.........gagctgtttt | 3053 | C A T S D L Q L A G G S D E L F F |
| 24.15 | TRBV24-1*01 | TRBJ2-3*01 | | 1358 | tgtgccaccagtgatttg tcg agcacagatacgcagtatt | 3054 | C A T S D L S S T D T Q Y F |
| 24.16 | TRBV24-1*01 | TRBJ2-3*01 | TRBD1*01 | 1359 | tgtgccaccagtgat....ct..gacaggg....ct..agcacagatacgcagtatt | 3055 | C A T S D L T G A S T D T Q Y F |
| 24.17 | TRBV24-1*01 | TRBJ1-1*01 | TRBD2*02 | 1360 | tgtgccaccagtgatttg acaccc........ggaggg.....actgaagctttctt | 3056 | C A T S D L T P G G T E A F |
| 24.18 | TRBV24-1*01 | TRBJ2-1*01 | TRBD1*01 | 1361 | tgtgccaccagtgatttg t......gggg..tgg......tgagcagttcttc | 3057 | C A T S D L W G G E Q F F |
| 24.19 | TRBV24-1*01 | TRBJ2-2*01 | TRBD1*01 | 1362 | tgtgccaccagtgat...cccgaa.....gggc agaaa..aacacggggagctgtttt | 3058 | C A T S D P E G Q K N T G E L F F |
| 24.20 | TRBV24-1*01 | TRBJ2-5*01 | TRBD2*01 | 1363 | tgtgccaccagtgat..ccacc........cggggg..cag...acacggggagctgagctgtttt | 3059 | C A T S D P P R G A D T G E L F F |
| 24.21 | TRBV24-1*01 | TRBJ2-5*01 | TRBD1*01 | 1364 | tgtgccaccagtga...ccctaggg....caggggg...tggt.......ccagtacttc | 3060 | C A T S D P R A G V V Q Y F |
| 24.22 | TRBV24-1*01 | TRBJ2-1*01 | TRBD2*01 | 1365 | tgtgccaccagtga...cccatc......cggggg..agt......tgagcagttcttc | 3061 | C A T S D P S G G V E Q F F |
| 24.23 | TRBV24-1*01 | TRBJ2-4*01 | | 1366 | tgtgccaccagtga.....ccctatctacccggcct..gccaaaaacattcagtacttc | 3062 | C A T S D P Y L P G L A K N I Q Y F |
| 24.24 | TRBV24-1*01 | TRBJ2-1*01 | TRBD1*01 | 1367 | tgtgccaccagtga.....cca..acaggg....t..tcctacaatgagcagttcttc | 3063 | C A T S D Q Q G S Y N E Q F F |
| 24.25 | TRBV24-1*01 | TRBJ2-2*01 | TRBD2*01 | 1368 | tgtgccaccagtga...cca..gactagcgggg...tt....accgggagctgtttt | 3064 | C A T S D Q T S G V T G E L F F |
| 24.26 | TRBV24-1*01 | TRBJ2-3*01 | TRBD2*01 | 1369 | tgtgccacc........tccgatcggc..ggact......agcacagatacgcagtatt | 3065 | C A T S D R R T S T D T Q Y F |
| 24.27 | TRBV24-1*01 | TRBJ2-1*01 | TRBD2*01 | 1370 | tgtgccaccagtgatt..c......cggggg..aggaaatacaactgagcat..........ttcttc | 3066 | C A T S D S G G R K Y T E H F F |
| 24.28 | TRBV24-1*01 | TRBJ2-3*01 | TRBD2*02 | 1371 | tgtgccaccagtga.....ctcaggcat...gaggg agcc..cacagatacgcagtatt | 3067 | C A T S D S G M R E P T D T Q Y F |
| 24.29 | TRBV24-1*01 | TRBJ2-7*01 | TRBD2*01 | 1372 | tgtgccaccagtgatt..cgcatcaa.....agc........c.....acgagcagttcttc | 3068 | C A T S D S H Q S H E Q Y F |
| 24.30 | TRBV24-1*01 | TRBJ2-1*01 | TRBD2*02 | 1373 | tgtgccaccagtgatt......ctagcgggag..agaa....tacaatgagcagttcttc | 3069 | C A T S D S S G R E Y N E Q F F |
| 24.31 | TRBV24-1*01 | TRBJ2-3*01 | TRBD2*01 | 1374 | tgtgccaccagtgat...accgagagctt..gaca......aatacc...........cagtattt | 3070 | C A T S D T E S L T N T Q Y F |
| 24.32 | TRBV24-1*01 | TRBJ2-2*01 | TRBD1*01 | 1375 | tgtgccaccagtga.....ggga....agggg..tacgt.......cgggagctgtttt | 3071 | C A T S E G R G Y V G E L F F |
| 24.33 | TRBV24-1*01 | TRBJ2-1*01 | TRBD1*01 | 1376 | tgtgccaccagtga...acgagaaat gggacag..... ac ....caatgagcagttcttc | 3072 | C A T S E R E M G Q T N E Q F F |
| 24.34 | TRBV24-1*01 | TRBJ2-7*01 | TRBD1*01 | 1377 | tgtgccaccagtga....ac..ggacag....cgactc...acgagcagtactc | 3073 | C A T S E R T A T H E Q Y F |
| 24.35 | TRBV24-1*01 | TRBJ2-3*01 | TRBD2*02 | 1378 | tgtgccaccag......cttcaggaccct..........gaggg aa......atacccagtattt | 3074 | C A T S F R T P E G N T Q Y F |
| 24.36 | TRBV24-1*01 | TRBJ1-1*01 | TRBD2*02 | 1379 | tgtgccaccagtg...........gggagg ttgcg......actgaagctttctt | 3075 | C A T S G E V A T E A F F |
| 24.37 | TRBV24-1*01 | TRBJ2-2*01 | TRBD1*01 | 1380 | tgtgccaccagt......ccc..ggacaggggc g gt...caccgggagctgtttt | 3076 | C A T S P G Q G A V T G E L F F |

Figure 1-51

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 24.38 | TRBV24-1*01 | TRBJ2-1*01 | TRBD2*01 | 1381 | tgtgccacca | cc | gcagggg | actata | acaatgagcagttcttc | 3077 | C A T T A G D Y N N E Q F F |
| 25.001 | TRBV25-1*01 | TRBJ1-1*01 | TRBD2*01 | 1382 | tgtgccagc | gccg | tagc | tg | tgaacactgaagcttcttt | 3078 | C A S A V A V N T E A F F |
| 25.002 | TRBV25-1*01 | TRBJ2-2*01 | TRBD2*01 | 1383 | tgtgccagc | ga | actagc | cgt | cgggagctgttttt | 3079 | C A S E L A V G E L F F |
| 25.003 | TRBV25-1*01 | TRBJ2-3*01 | TRBD1*01 | 1384 | tgtgccagc | | ggacaggg | actgag | gcagtatttt | 3080 | C A S G Q G V R Q Y F |
| 25.004 | TRBV25-1*01 | TRBJ2-2*01 | TRBD1*01 | 1385 | tgtgccagc | cggat | tattt | ccgggagctgttttt | | 3081 | C A S R M G Y S G E L F F |
| 25.005 | TRBV25-1*01 | TRBJ2-7*01 | TRBD1*01 | 1386 | tgtgccagcagtg | cc | caggggg | agct | ctacgagcagtactc | 3082 | C A S S A Q G E L Y E Q Y F |
| 25.006 | TRBV25-1*01 | TRBJ2-1*01 | TRBD1*01 | 1387 | tgtgccagcagtg | c | gacag | agttg | atgagcagttcttc | 3083 | C A S S A T E F D E Q F F |
| 25.007 | TRBV25-1*01 | TRBJ2-5*01 | TRBD2*02 | 1388 | tgtgccagcagtga | ggcc | gcgggaggg | gtagg | agagaccagtactc | 3084 | C A S S E A A G G V G E T Q Y F |
| 25.008 | TRBV25-1*01 | TRBJ1-2*01 | TRBD1*01 | 1389 | tgtgccagcagtga | gacag | ttggc | atgctcacctc | | 3085 | C A S S E T V G H G Y T F |
| 25.009 | TRBV25-1*01 | TRBJ2-1*01 | TRBD1*01 | 1390 | tgtgccagcagtgaata | cga | ggac | gc gag ctctacaatgagcagttcttc | | 3086 | C A S S E Y E D A S S Y N E Q F F |
| 25.010 | TRBV25-1*01 | TRBJ2-3*01 | | 1391 | tgtgccagcagtgaata ta | aggctccgaaagcacaagat | | gatacgcagtattt | | 3087 | C A S S E Y K A P K A Q D D T Q Y F |
| 25.011 | TRBV25-1*01 | TRBJ2-3*01 | TRBD1*01 | 1392 | tgtgccagcagtgaata | ctctt | ggc | gcacagatacgcagtattti | | 3088 | C A S S E Y S W R T D T Q F F |
| 25.012 | TRBV25-1*01 | TRBJ2-1*01 | TRBD2*02 | 1393 | tgtgccagcagt | tt | tagcgggag | t | tacaatgagcagttcttc | 3089 | C A S S F S G G S Y N E Q F F |
| 25.013 | TRBV25-1*01 | TRBJ2-7*01 | TRBD1*01 | 1394 | tgtgccagcagt | ct | agggg | | ctacgagcagtactc | 3090 | C A S S L G G Y E Q Y F |
| 25.014 | TRBV25-1*01 | TRBJ2-7*01 | TRBD1*01 | 1395 | tgtgccagcagtg | t | agggg | | acgagcagtactc | 3091 | C A S S V G D E Q Y F |
| 25.015 | TRBV25-1*01 | TRBJ2-3*01 | TRBD2*01 | 1396 | tgtgccag | taccat | ggggg | | agatacgcagtactc | 3092 | C A S T P G D T Q Y F |
| 25.016 | TRBV25-1*01 | TRBJ2-1*01 | TRBD1*01 | 1397 | tgtgccagca | ccc | cggg | | agatacgcagtactc | 3093 | C A S T M G D E Q F F |
| 25.017 | TRBV25-1*01 | TRBJ2-1*01 | TRBD2*01 | 1398 | tgtgccagc | c | gact | cttcttaggaatgcat | aatgagcagttcttc | 3094 | C A S R L F L G C H N E Q F F |
| 27.001 | TRBV27*01 | TRBJ1-1*01 | | 1399 | tgtgcc | gccagaatcatccatctccatacaatgatcac | | | ttcttc | 3095 | C A A R I H P S P Y N D H F F |
| 27.002 | TRBV27*01 | TRBJ2-7*01 | TRBD1*01 | 1400 | tgtgcc | gccagatt | acaggggc | aaattacgagg | agtactc | 3096 | C A A R L Q G A N Y E E Y F |
| 27.003 | TRBV27*01 | TRBJ1-1*01 | TRBD2*01 | 1401 | tgtgcc | cag | caggggg | ccgctcctgtgc | acactgaagcttcttt | 3097 | C A Q Q G P L L W H T E A F F |
| 27.004 | TRBV27*01 | TRBJ1-1*01 | TRBD2*02 | 1402 | tgtgccag | tgaaag | gcgggagg | cctccgtcg | cctacaatgagcagttcttc | 3098 | C A S E R R E A S V A Y N E Q F F |
| 27.005 | TRBV27*01 | TRBJ1-1*01 | TRBD1*01 | 1403 | tgtgccag | ttcccggg | ggggc | cg | acactgaagcttcttt | 3099 | C A S F P G G A D T E A F F |
| 27.006 | TRBV27*01 | TRBJ2-3*01 | | 1404 | tgtgccagc | ggccacggcctac | ct agcacagatacgcagtatttt | | | 3100 | C A S G H G L P S T D T Q Y F |
| 27.007 | TRBV27*01 | TRBJ2-7*01 | TRBD2*01 | 1405 | tgtgccagc | gggttacggggcct | ctag | t | gagcagtactc | 3101 | C A S G L R A S S E Q Y F |
| 27.008 | TRBV27*01 | TRBJ2-7*01 | | 1406 | tgtgccagc | ggctggaagct | gcagtactc | | | 3102 | C A S G W K L Q Y F |
| 27.009 | TRBV27*01 | TRBJ2-7*01 | TRBD1*01 | 1407 | tgtgccagca | a | gacagg | aa | cctacgagcagtactc | 3103 | C A S K T G T Y E Q Y F |

Figure 1-52

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 27.010 | TRBV27*01 | TRBJ2-7*01 | TRBD2*01 | 1408 | tgtgccagca | aggt | ggg | tcctc | cctacgagcagtacttc | 3104 | C A S K V G P P Y E Q Y F |
| 27.011 | TRBV27*01 | TRBJ2-5*01 | TRBD2*02 | 1409 | tgtgccagc | tta | ggagg | tcccccgg | agagaccagtacttc | 3105 | C A S L G G P P P G E T Q Y F |
| 27.012 | TRBV27*01 | TRBJ2-3*01 | TRBD2*01 | 1410 | tgtgccagca | atctaggaacatt | cgggg | attccga | tattt | 3106 | C A S N L G T F G D S R Y F |
| 27.013 | TRBV27*01 | TRBJ2-4*01 | TRBD2*01 | 1411 | tgtgccagcag | ggatcaa | gggggg | | acattcagtacttc | 3107 | C A S R D Q G G D I Q Y F |
| 27.014 | TRBV27*01 | TRBJ2-7*01 | TRBD1*01 | 1412 | tgtgccagc | c | gggacagg | accgacgagg | cgagtacttc | 3108 | C A S R D R T D E G Q Y F |
| 27.015 | TRBV27*01 | TRBJ2-2*01 | TRBD2*01 | 1413 | tgtgccagcag | | ggggg | t ggggagctgttttt | | 3109 | C A S R G G G E L F F |
| 27.016 | TRBV27*01 | TRBJ2-1*01 | TRBD1*01 | 1414 | tgtgccagcag | aat | acag | ccatctcca | tacaatgagcagttcttc | 3110 | C A S R I Q P S P Y N E Q F F |
| 27.017 | TRBV27*01 | TRBJ1-2*01 | TRBD1*01 | 1415 | tgtgccagcag | aaa | gaca | cgtcgg | tatgctacacctc | 3111 | C A S R K T R R Y G Y T F |
| 27.018 | TRBV27*01 | TRBJ2-7*01 | TRBD2*02 | 1416 | tgtgccagc | c | gactagcgggag | tca | acgagcagtacttc | 3112 | C A S R L A G V N E Q Y F |
| 27.019 | TRBV27*01 | TRBJ2-7*01 | TRBD2*02 | 1417 | tgtgccagc | cggctct | tagcgggag | cctacgagcagtacttc | | 3113 | C A S R L L A G A Y E Q Y F |
| 27.020 | TRBV27*01 | TRBJ2-7*01 | TRBD2*02 | 1418 | tgtgccagcag | aac | cgggag | cctcgg | cgagcagtacttc | 3114 | C A S R T G S L G E Q Y F |
| 27.021 | TRBV27*01 | TRBJ2-1*01 | TRBD1*01 | 1419 | tgtgccagcag | | gacaaggg | tcgtg | aatgagcagttcttc | 3115 | C A S R T G V V N E Q F F |
| 27.022 | TRBV27*01 | TRBJ2-1*01 | TRBD1*01 | 1420 | tgtgccagcag | aacatc | gaca | tctccataccatgac | cagttcttc | 3116 | C A S R T S T S P Y H D Q F F |
| 27.023 | TRBV27*01 | TRBJ1-5*01 | TRBD1*01 | 1421 | tgtgccagcagt | gatgcc | cagg | tatcg | aatcagcccagcattt | 3117 | C A S S D G Q V S N Q P Q H F |
| 27.024 | TRBV27*01 | TRBJ1-2*01 | TRBD1*01 | 1422 | tgtgccagcagt | gaccgtcc | ggggg | tag | atgctacacctc | 3118 | C A S S D R P G V D G Y T F |
| 27.025 | TRBV27*01 | TRBJ1-2*01 | TRBD1*01 | 1423 | tgtgccagcagttt | c | ggaacaggg | a | tatggctacacctc | 3119 | C A S S F G Q G Y G Y T F |
| 27.026 | TRBV27*01 | TRBJ1-1*01 | TRBD2*02 | 1424 | tgtgccagcagttt | t | gggag | aggg | actgaagctttctt | 3120 | C A S S F G R G T E A F F |
| 27.027 | TRBV27*01 | TRBJ2-7*01 | TRBD2*01 | 1425 | tgtgccagcagttt | c gggactagcg | | t ctcctacgagcagtacttc | | 3121 | C A S S F G T S V S Y E Q Y F |
| 27.028 | TRBV27*01 | TRBJ1-2*01 | TRBD1*01 | 1426 | tgtgccagcagttt | ttt | gggg | a taactatggctacacctc | | 3122 | C A S S F L G D N Y G Y T F |
| 27.029 | TRBV27*01 | TRBJ1-5*01 | TRBD2*01 | 1427 | tgtgccagcagttt | ccc gggacaggg | | t | tacaatgagcccagcattc | 3123 | C A S S F P G Q G Y N E Q F F |
| 27.030 | TRBV27*01 | TRBJ1-2*01 | | 1428 | tgtgccagcagttt | ctccgacg | | | acaatgagcagttcttc | 3124 | C A S S F S D D N E Q F F |
| 27.031 | TRBV27*01 | TRBJ2-1*01 | TRBD1*01 | 1429 | tgtgccagcagttt | c | acaggg | ttc | atgagcagttctt | 3125 | C A S S F T G V H E Q F F |
| 27.032 | TRBV27*01 | TRBJ2-1*01 | TRBD1*01 | 1430 | tgtgccagcagttt | cactct c gggacagggg | ga | acgagcagtacttc | | 3126 | C A S S F T L G T G G N E Q Y F |
| 27.033 | TRBV27*01 | TRBJ1-5*01 | TRBD1*01 | 1431 | tgtgccagcagttt | lgt gacaggggc | | cagcccagcattt | | 3127 | C A S S F V T G G Q P Q H F |
| 27.034 | TRBV27*01 | TRBJ2-7*01 | TRBD2*01 | 1432 | tgtgccagc | tcc ggactag | a | ctacgagcagtacttc | | 3128 | C A S S G L D Y E Q Y F |
| 27.035 | TRBV27*01 | TRBJ2-7*01 | TRBD1*01 | 1433 | tgtgccagcagt | ggctact | cagggg | acgagcagtacttc | | 3129 | C A S S G Y S G D E Q Y F |
| 27.036 | TRBV27*01 | TRBJ2-1*01 | TRBD1*01 | 1434 | tgtgccagcag | ccatt ggacagggg | agtc | cgagcagttcttc | | 3130 | C A S S H W T G E S E Q Y F |
| 27.037 | TRBV27*01 | TRBJ2-5*01 | TRBD1*01 | 1435 | tgtgccagcagt | at c gggacaggggg | gcca | caagagaccagtacttc | | 3131 | C A S S I G T G G P Q E T Q Y F |

Figure 1-53

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 27.038 | TRBV27*01 | TRBJ2-5*01 | TRBD2*01 | 1436 | tgtgccagcag | cattaggaggg | gcgggggg | gagacccagtactlc | | 3132 | C A S S I R R G G E T Q Y F |
| 27.039 | TRBV27*01 | TRBJ2-1*01 | TRBD2*02 | 1437 | tgtgccagcagt | at | tagcggaggg gg | aatgagcagttctlc | | 3133 | C A S S I S G R G N E Q F F |
| 27.040 | TRBV27*01 | TRBJ2-7*01 | TRBD1*01 | 1438 | tgtgccagcagtta. g | caggggg | ctacgagcagtactlc | | | 3134 | C A S S L A G G Y E Q Y F |
| 27.041 | TRBV27*01 | TRBJ2-5*01 | TRBD2*01 | 1439 | tgtgccagcagt | ctcgcc ggactacgg | agatgg | gagacccagtactlc | | 3135 | C A S S L A G L A R W E T Q Y F |
| 27.042 | TRBV27*01 | TRBJ2-1*01 | TRBD2*02 | 1440 | tgtgccagcagtta. | gagga | agcgggag. tcgcgagg | aatgagcagttctlc | | 3136 | C A S S L E E A G V A R N E Q F F |
| 27.043 | TRBV27*01 | TRBJ2-1*01 | TRBD2*01 | 1441 | tgtgccagcagttat. tt | gcggg | ctctacaatgagcagttcttc | | | 3137 | C A S S L F A G S Y N E Q F F |
| 27.044 | TRBV27*01 | TRBJ2-1*01 | | 1442 | tgtgccagcagtttat. tcgat | | aatgagcagttcttc | | | 3138 | C A S S L F D N E Q F F |
| 27.045 | TRBV27*01 | TRBJ2-1*01 | TRBD1*01 | 1443 | tgtgccagcagtttat. ttggag | cagggg. gggg | aatgagcagttcttc | | | 3139 | C A S S L F G A G G G N E Q F F |
| 27.046 | TRBV27*01 | TRBJ2-2*01 | | 1444 | tgtgccagcagtttat. tcttgt | ccgggagctgttttt | | | | 3140 | C A S S L F L S G E L F F |
| 27.047 | TRBV27*01 | TRBJ2-1*01 | | 1445 | tgtgccagcagttat. t | caggggg. tt | atgagcagttcttc | | | 3141 | C A S S L F R G Y E Q F F |
| 27.048 | TRBV27*01 | TRBJ2-3*01 | TRBD2*01 | 1446 | tgtgccagcagttat. tttctccaggagtgggt | actagcg | ttgaagggg | agatacgcagtatttt | | 3142 | C A S S L F S P G V G T S V G R G D T Q Y F |
| 27.049 | TRBV27*01 | TRBJ2-4*01 | TRBD1*01 | 1447 | tgtgccagcagtta. | ggggc cctttatgaaaacattcat | tactlc | | | 3143 | C A S S L G A L Y E N I H Y F |
| 27.050 | TRBV27*01 | TRBJ2-2*01 | TRBD1*01 | 1448 | tgtgccagcagtta. | ggggc. caccgggagctgttttt | | | | 3144 | C A S S L G A T G E L F F |
| 27.051 | TRBV27*01 | TRBJ2-3*01 | | 1449 | tgtgccagcagtta. ggcttt | cacagatacgcagtattt | | | | 3145 | C A S S L G F T D T Q Y F |
| 27.052 | TRBV27*01 | TRBJ2-7*01 | TRBD2*01 | 1450 | tgtgccagcagtta. | ggg tcagtcacg | ggcagtacttc | | | 3146 | C A S S L G S V T E Q Y F |
| 27.053 | TRBV27*01 | TRBJ2-7*01 | TRBD2*02 | 1451 | tgtgccagcagtta. gat | tagcggga. a | ctacgagcagtactlc | | | 3147 | C A S S L I S G N Y E Q Y F |
| 27.054 | TRBV27*01 | TRBJ2-7*01 | TRBD1*01 | 1452 | tgtgccagcagtta. aa ggacaggggg. a | tcctacgagcagtactlc | | | | 3148 | C A S S L K D R G S Y E Q Y F |
| 27.055 | TRBV27*01 | TRBJ2-1*01 | TRBD2*02 | 1453 | tgtgccagcagttt. gctctctttcg | gcgggaggcgcggag | atgagcagttcttc | | | 3149 | C A S S L L S F G G R A G D E Q F F |
| 27.056 | TRBV27*01 | TRBJ2-1*01 | TRBD2*02 | 1454 | tgtgccagcagtt. gctctctttcg | gcgggaggcgcgga | aatgagcagttcttc | | | 3150 | C A S S L L S F G G R A G N E Q F F |
| 27.057 | TRBV27*01 | TRBJ2-5*01 | | 1455 | tgtgccagcagtta. aaccgaa | aagagacccagtactlc | | | | 3151 | C A S S L N R K E T Q Y F |
| 27.058 | TRBV27*01 | TRBJ1-5*01 | TRBD1*01 | 1456 | tgtgccagcagtttt. g | cagg. ct | aatcagcccacagcatttt | | | 3152 | C A S S L Q A N Q P Q H F |
| 27.059 | TRBV27*01 | TRBJ2-7*01 | TRBD1*01 | 1457 | tgtgccagcagt. ctc | caggggg. acacca | cctacgagcagtactlc | | | 3153 | C A S S L Q G D T T Y E Q Y F |
| 27.060 | TRBV27*01 | TRBJ2-7*01 | | 1458 | tgtgccagcagtta. agagctcctc ctcctacgagcagtactlc | | | | | 3154 | C A S S L R A P S S Y E Q Y F |
| 27.061 | TRBV27*01 | TRBJ2-7*01 | TRBD1*01 | 1459 | tgtgccagcagtta. aggg | aatcg | tacgagcagtactlc | | | 3155 | C A S S L R E S Y E Q Y F |
| 27.062 | TRBV27*01 | TRBJ2-3*01 | TRBD2*02 | 1460 | tgtgccagcagtta. a | gaggg gc | cacagatacgcagtatttt | | | 3156 | C A S S L R G A T D T Q Y F |
| 27.063 | TRBV27*01 | TRBJ1-2*01 | TRBD1*01 | 1461 | tgtgccagcagttatc g g | cagggggc | ggctacacctlc | | | 3157 | C A S S L S A G G G Y T F |
| 27.064 | TRBV27*01 | TRBJ1-1*01 | TRBD1*01 | 1462 | tgtgccagcagttatc c | gacagggggc gc ag | caatgagcagttcttc | | | 3158 | C A S S L S D R G R S N E Q F F |
| 27.065 | TRBV27*01 | TRBJ2-6*01 | | 1463 | tgtgccagcagtt. g tctggggccaacctgcactlc | | | | | 3159 | C A S S L S G A N V L T F |

Figure 1-54

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 27.066 | TRBV27*01 | TRBJ2-7*01 | TRBD2*01 | 1464 | tgtgccagcag..... | ccta ..... | agcgggg.. ca | ..cc | tacgagcagtactc | 3160 | C A S S L S G G T Y E Q Y F |
| 27.067 | TRBV27*01 | TRBJ2-1*01 | TRBD2*02 | 1465 | tgtgccagcagtta.. | agtctggt | ....ctagcggga... at | ....... | tgagcagttcttc | 3161 | C A S S L S L G L A G I E Q F F |
| 27.068 | TRBV27*01 | TRBJ2-1*01 | TRBD2*01 | 1466 | tgtgccagcagttatc | ccttta | gga.......... | atg.. | acaatgagcagttcttc | 3162 | C A S S L L G N D N E Q F F |
| 27.069 | TRBV27*01 | TRBJ2-3*01 | TRBD2*02 | 1467 | tgtgccagcagtttat | o gc | ..ctagcgggag.. ttcaa | ..... | ataccgagcagtattt | 3163 | C A S S L P S G S S N T Q Y F |
| 27.070 | TRBV27*01 | TRBJ2-1*01 | TRBD1*01 | 1468 | tgtgccagcagttta.. | ag | ...cagggg.. actcct | ..... | caatgagcagttcttc | 3164 | C A S S L S R G L L N E Q F F |
| 27.071 | TRBV27*01 | TRBJ2-7*01 | TRBD2*02 | 1469 | tgtgccagcagttatc | ......... | gaggg gctccct | ... | ctacgagcagtactc | 3165 | C A S S L S R G S L Y E Q Y F |
| 27.072 | TRBV27*01 | TRBJ1-1*01 | TRBD1*01 | 1470 | tgtgccagcagttatc | aa | ggacagg.. tctag | ..... | tgaagcttctt | 3166 | C A S S L S R T G S S E A F F |
| 27.073 | TRBV27*01 | TRBJ1-1*01 | | 1471 | tgtgccagcagttta.. | agctctcccct | .... | caatgagcagttcttc | | 3167 | C A S S L S S P L N E Q F F |
| 27.074 | TRBV27*01 | TRBJ2-1*01 | TRBD1*01 | 1472 | tgtgccagcagttat | ct | ....gggg. tcacccaa | ...... | aatgagcagttcttc | 3168 | C A S S L S W G S P Q N E Q F F |
| 27.075 | TRBV27*01 | TRBJ2-1*01 | TRBD1*02 | 1473 | tgtgccagcagt..... | ctaccta | ......gaggg tac. | ........ | gagcagttcttc | 3169 | C A S S L T L G G Y E Q F F |
| 27.076 | TRBV27*01 | TRBJ2-7*01 | TRBD2*02 | 1474 | tgtgccagcagtta.. | ....actagcggga... ca | .. | tacgagcagtactc | | 3170 | C A S S L T S G T Y E Q Y F |
| 27.077 | TRBV27*01 | TRBJ2-7*01 | TRBD2*01 | 1475 | tgtgccagcagtta.. | gttagc | ....ctagcgggag.. ag | ... | tacgagcagtactc | 3171 | C A S S L V S L A G E Y E Q Y F |
| 27.078 | TRBV27*01 | TRBJ2-3*01 | TRBD1*01 | 1476 | tgtgccagcagttat | gggac | ......ggaaccatg | .gataccgagtattt | | 3172 | C A S S L W D G T M D T Q Y F |
| 27.079 | TRBV27*01 | TRBJ2-6*01 | TRBD1*01 | 1477 | tgtgccagcagttat | ......... | ggggag ..ctggggccaacctcctgacttc | | | 3173 | C A S S L W G A G A N V L T F |
| 27.080 | TRBV27*01 | TRBJ1-4*01 | TRBD1*01 | 1478 | tgtgccagcagttat | accc | ...acagg... | ........ | aaaactgtttt | 3174 | C A S S L Y P Q G K L F F |
| 27.081 | TRBV27*01 | TRBJ2-7*01 | TRBD1*01 | 1479 | tgtgccagcagt..... | ctatact | ..cagggggc tcagg | ...... | cgagcagtactc | 3175 | C A S S L Y S G G G G E Q Y F |
| 27.082 | TRBV27*01 | TRBJ2-1*01 | TRBD2*01 | 1480 | tgtgccagcag..... | cct | .gacag.. | tctct | ..ctacaatgagcagttcttc | 3176 | C A S S P D S L L Y N E Q F F |
| 27.083 | TRBV27*01 | TRBJ2-2*01 | | 1481 | tgtgccagcag..... | cccattcttgtcgcgagctgta | ........ | | ...tttt | 3177 | C A S S P F L S G E L Y F |
| 27.084 | TRBV27*01 | TRBJ2-1*01 | TRBD2*02 | 1482 | tgtgccagcag..... | ccctggg | ....ctagcgggag... t | ... | tacaatgagcagttcttc | 3178 | C A S S P G A S G S Y N E Q F F |
| 27.085 | TRBV27*01 | TRBJ2-7*01 | TRBD1*01 | 1483 | tgtgccagcagt..... | cc | gggacaggg... agg | ..ctacgagcagtactc | | 3179 | C A S S P G Q G G Y E Q Y F |
| 27.086 | TRBV27*01 | TRBJ2-7*01 | TRBD2*01 | 1484 | tgtgccagcagt..... | ccc | gggact......... | gccgc | .....cgagcagtactc | 3180 | C A S S P G T A A E Q Y F |
| 27.087 | TRBV27*01 | TRBJ2-1*01 | TRBD1*01 | 1485 | tgtgccagcagt..... | ccg | gggacagggggc ta | ...ctacaatgagcagttcttc | | 3181 | C A S S P G T G G Y Y N E Q F F |
| 27.088 | TRBV27*01 | TRBJ1-3*01 | TRBD1*01 | 1486 | tgtgccagcag..... | cccc | gggac....... gattga | ctctgaaacaccatatttt | | 3182 | C A S S P G T I D S G N T I Y F |
| 27.089 | TRBV27*01 | TRBJ2-3*01 | TRBD1*01 | 1487 | tgtgccagcagt..... | cccaccc | ..gacagg... tctg | ....cagatacgcagtatttt | | 3183 | C A S S P H P T G S A D T Q Y F |
| 27.090 | TRBV27*01 | TRBJ1-2*01 | TRBD1*01 | 1488 | tgtgccagcagt..... | ccccctga | ..gacag...... cgggag | ........ | atggctacaccttc | 3184 | C A S S P L E T A G D G Y T F |
| 27.091 | TRBV27*01 | TRBJ1-2*01 | TRBD1*01 | 1489 | tgtgccagcag..... | cccctcaagacag c ggga.... | g | ... | atggctacaccttc | 3185 | C A S S P L K T A G D G Y T F |
| 27.092 | TRBV27*01 | TRBJ2-3*01 | TRBD2*01 | 1490 | tgtgccagcag..... | cccac | .....cgggg... aag | ....... | acgcagtatttt | 3186 | C A S S P P G K T Q Y F |
| 27.093 | TRBV27*01 | TRBJ2-7*01 | TRBD2*02 | 1491 | Vtgtgccagcagt..... | cccgggg | .....agcgggaggg c | ..cc | tacgagcagtactc | 3187 | C A S S P R G A G G P Y E Q Y F |

Figure 1-55

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 27.094 | TRBV27*01 | TRBJ1-6*01 | TRBD1*01 | 1492 | tgtgccagcagt.. | ccaaggggtt.cc | ggaaca...... | agtc...... | aattcacccctcacttt | 3188 | C A S S P R V P G Q V N S P L H F |
| 27.095 | TRBV27*01 | TRBJ1-1*01 | TRBD1*01 | 1493 | tgtgccagcagt.. | ccatc..gacaggg..ccc | ...ctgaagcttcttt | | | 3189 | C A S S P S T G A P E A F F |
| 27.096 | TRBV27*01 | TRBJ1-5*01 | TRBD1*01 | 1494 | tgtgccagcagt.. | ccctc..gacaggggc ag | ...tcagcccagcattt | | | 3190 | C A S S P S T G G S Q P Q H F |
| 27.097 | TRBV27*01 | TRBJ2-7*01 | TRBD1*01 | 1495 | tgtgccagcagt.. | cccaccg...caggggc | cgaa......acgagcagtacttc | | | 3191 | C A S S P T A G G R N E Q Y F |
| 27.098 | TRBV27*01 | TRBJ2-2*01 | | 1496 | tgtgccagcagt.. | ccct..acaccggggagctgttttt | | | | 3192 | C A S S P Y T G E L F F |
| 27.099 | TRBV27*01 | TRBJ2-7*01 | TRBD1*01 | 1497 | tgtgccagcagt.. | cagacct cc gggacag.... ca | .tacgagcagtacttc | | | 3193 | C A S S Q T S G T A Y E Q Y F |
| 27.100 | TRBV27*01 | TRBJ1-2*01 | TRBD2*01 | 1498 | tgtgccagcagt.. | ag......agcgg......ca | ..aactatggctacacctc | | | 3194 | C A S S R A A N Y G Y T F |
| 27.101 | TRBV27*01 | TRBJ2-5*01 | TRBD2*01 | 1499 | tgtgccagcagt.. | cg......agcgg...... | atcc ..ccaagagaccagtacttc | | | 3195 | C A S S R A D P Q E T Q Y F |
| 27.102 | TRBV27*01 | TRBJ2-2*01 | TRBD2*02 | 1500 | tgtgccagcagt.. | cgag ......gggag.. t | ......ccggggagctgttttt | | | 3196 | C A S S R G E S G E L F F |
| 27.103 | TRBV27*01 | TRBJ2-7*01 | TRBD1*01 | 1501 | tgtgccagcag.. | cc..gacagggg..ata | ..cctacgagcagtacttc | | | 3197 | C A S S R Q G D T Y E Q Y F |
| 27.104 | TRBV27*01 | TRBJ2-3*01 | TRBD2*01 | 1502 | tgtgccagcagt.. | cagatg....ctagc...... | tgggga...acagatacgcagtatttt | | | 3198 | C A S S D A S W G T D T Q Y F |
| 27.105 | TRBV27*01 | TRBJ2-7*01 | TRBD1*01 | 1503 | tgtgccagcagt.. | caga gggacag.....cga | ..cctacgagcagtacttc | | | 3199 | C A S S E C Q A T Y E Q Y F |
| 27.106 | TRBV27*01 | TRBJ1-2*01 | TRBD1*01 | 1504 | tgtgccagcagt.. | ctttc..gacag...... | ctatggctacacctc | | | 3200 | C A S S F D S Y G Y T F |
| 27.107 | TRBV27*01 | TRBJ2-1*01 | | 1505 | tgtgccagcagt.. | ccggtggcct ....caatgagcagttcttc | | | | 3201 | C A S S G G L N E Q F F |
| 27.108 | TRBV27*01 | TRBJ1-1*01 | TRBD1*01 | 1506 | tgtgccagcagt.. | ccgg......caagg.... tt | ...cactgaagcttcttt | | | 3202 | C A S S G R F T E A F F |
| 27.109 | TRBV27*01 | TRBJ1-1*01 | | 1507 | tgtgccagcagt.. | ccctccctata ......tgaagcttcttt | | | | 3203 | C A S S L P L Y E A F F |
| 27.110 | TRBV27*01 | TRBJ2-1*01 | TRBD2*02 | 1508 | tgtgccagcagt.. | cccaagga ccc gggactagccggag.. tt | ...tacaatgagcagttcttc | | | 3204 | C A S S Q D P G L A G V Y N E Q F F |
| 27.111 | TRBV27*01 | TRBJ1-5*01 | TRBD1*01 | 1509 | tgtgccagcagt.. | caacc ..ggacaggg.. a | ...aatcagcccagcattt | | | 3205 | C A S S T G Q G N Q P Q H F |
| 27.112 | TRBV27*01 | TRBJ2-7*01 | TRBD2*01 | 1510 | tgtgccagcagt.. | cctggga ......taqcgg.... a | ag ctctacgagcagtacttc | | | 3206 | C A S S W D S G S S Y E Q Y F |
| 27.113 | TRBV27*01 | TRBJ2-7*01 | TRBD1*01 | 1511 | tgtgccagcagt.. | cat ggga............ | ctcctacgagcagtacttc | | | 3207 | C A S S W D S Y E Q Y F |
| 27.114 | TRBV27*01 | TRBJ2-7*01 | TRBD2*01 | 1512 | tgtgccagcagt.. | cat ..acaggg.. agtc | ..cctacgagcagtacttc | | | 3208 | C A S S Y R G G P Y E Q Y F |
| 27.115 | TRBV27*01 | TRBJ1-2*01 | | 1513 | tgtgccagcagt.. | acagg.... actg ....tatggctacacctc | | | | 3209 | C A S S T G L Y G Y T F |
| 27.116 | TRBV27*01 | TRBJ2-2*01 | TRBD2*02 | 1514 | tgtgccagcagt..... | ac ......cggga.. t | ..gaacacacggggagctgttttt | | | 3210 | C A S S T G M N T G E L F F |
| 27.117 | TRBV27*01 | TRBJ1-5*01 | TRBD1*01 | 1515 | tgtgccagcagt.. | accc ..acaggggg | gggaatagcgtgatg..gcaatcagcccagcatttt | | | 3211 | C A S S T H R G G N S V D G N Q P Q H F |
| 27.118 | TRBV27*01 | TRBJ2-2*01 | TRBD1*01 | 1516 | tgtgccagcagt.. | gtaagac.. ..ggggc | caaaa ..aacaccggggagctgttttt | | | 3212 | C A S S V R R G P K N T G E L F F |
| 27.119 | TRBV27*01 | TRBJ1-5*01 | TRBD1*01 | 1517 | tgtgccagcagt.. | gggacagggg.. agttc | ...tcagcccagcattt | | | 3213 | C A S S W D R G G S Q P Q H F |
| 27.120 | TRBV27*01 | TRBJ2-2*01 | TRBD1*01 | 1518 | tgtgccagcagt.. | ggggt ......agggg...... | ..caccggggagctgttttt | | | 3214 | C A S S W G R G T G E L F F |
| 27.121 | TRBV27*01 | TRBJ2-3*01 | TRBD2*01 | 1519 | tgtgccagcagt.. | ggcagaaa ......cggg.... | .gcacagatacgcagtatttt | | | 3215 | C A S S W Q K R G T D T Q Y F |

Figure 1-56

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 27.122 | TRBV27*01 | TRBJ2-1*01 | TRBD2*02 | 1520 | tgtgccagcag | ct | ggactagcgggaggg | tag | atgagcagttcttc | 3216 | C A S S W T S G R V D E Q F F |
| 27.123 | TRBV27*01 | TRBJ2-1*01 | TRBD2*01 | 1521 | tgtgccagcagtt | acttc | gcggg | aatgagcagttcttc | | 3217 | C A S S Y F R G N E Q F F |
| 27.124 | TRBV27*01 | TRBJ2-7*01 | TRBD2*02 | 1522 | tgtgccagcagtt | accta | aggg tac | cgagcagtactc | | 3218 | C A S S Y L K G T E Q Y F |
| 27.125 | TRBV27*01 | TRBJ2-2*01 | | 1523 | tgtgccagca | ctgacg | | ccggggagctgtttt | | 3219 | C A S T D A G E L F F |
| 27.126 | TRBV27*01 | TRBJ2-3*01 | TRBD2*02 | 1524 | tgtgccagca | cc | ggag | gcacagatacgcagtattt | | 3220 | C A S T G G T D T Q Y F |
| 27.127 | TRBV27*01 | TRBJ2-2*01 | TRBD2*01 | 1525 | tgtgccagca | ca | agcgggggg | accggggagctgtttt | | 3221 | C A S T S G G T G E L F F |
| 27.128 | TRBV27*01 | TRBJ2-1*01 | TRBD1*01 | 1526 | tgtgcca | ccagaat | acag | ccatctccatacaatgagcac | ttcttc | 3222 | C A T R I Q P S P Y N E H F F |
| 27.129 | TRBV27*01 | TRBJ2-1*01 | TRBD1*01 | 1527 | tgtgcca | cca | ggacaggg | tcgtgaatgagcat | ttcttc | 3223 | C A T R T G V V N E H F F |
| 27.130 | TRBV27*01 | TRBJ2-1*01 | TRBD1*01 | 1528 | tgtgcca | ccagtccg | gggacaggggc tactacaatgac | cagtcttc | | 3224 | C A T S P G T G G Y Y N D Q F F |
| 28.01 | TRBV28*01 | TRBJ1-1*01 | TRBD1*01 | 1529 | tgtgcc | tgctgttttggc | ggac | ctgaac | ctttcttt | 3225 | C A C C F G G P E P F F |
| 28.02 | TRBV28*01 | TRBJ2-2*01 | TRBD1*01 | 1530 | tgtgcc | tgcttct | ggggc g ggc | agctgtttt | | 3226 | C A C F W G G Q L F F |
| 28.03 | TRBV28*01 | TRBJ2-5*01 | TRBD2*01 | 1531 | tgtgcc | tgccagcctcc | gga | agtctctc | agagacccagtacttc | 3227 | C A C Q P P E G L S E T Q Y F |
| 28.04 | TRBV28*01 | TRBJ2-3*01 | TRBD2*01 | 1532 | tgtgcca | tca ggactagcg | | gcacagatacgcagtattt | | 3228 | C A I R T S G T D T Q Y F |
| 28.05 | TRBV28*01 | TRBJ2-7*01 | TRBD2*02 | 1533 | tgtgcca | ataaac | agcagga | ccgttaccagcaga | actc | 3229 | C A N K Q R D R Y Q Q N F |
| 28.06 | TRBV28*01 | TRBJ2-1*01 | | 1534 | tgtgccagc | gcctcaaa | ctacaatgagcagttcttc | | | 3230 | C A S A S N Y N E Q F F |
| 28.07 | TRBV28*01 | TRBJ1-1*01 | TRBD1*01 | 1535 | tgtgccagc | ga | gggc cgga | gaacactgaagctttcttt | | 3231 | C A S E G P E N T E A F F |
| 28.08 | TRBV28*01 | TRBJ1-3*01 | TRBD1*01 | 1536 | tgtgccagc | ttaccogcgctgg | cag | cctctgaaacaccatatttt | | 3232 | C A S F T R V A A S G N T I Y F |
| 28.09 | TRBV28*01 | TRBJ2-7*01 | TRBD1*01 | 1537 | tgtgccagc | ggttccggggaacctcctgtgt | ggggg a | ctacgagcagtactc | | 3233 | C A S G S G E P P V V G D Y E Q Y F |
| 28.10 | TRBV28*01 | TRBJ2-5*01 | TRBD1*01 | 1538 | tgtgccagca | agctgggacgg | caggggg att | gagaccagtacttc | | 3234 | C A S K L G R Q G I E T Q Y F |
| 28.11 | TRBV28*01 | TRBJ2-3*01 | TRBD2*02 | 1539 | tgtgccagca | agca | agcgggagg aatcg | gcacagatacgcagtatttt | | 3235 | C A S K Q A G G I G T D T Q Y F |
| 28.12 | TRBV28*01 | TRBJ2-1*01 | TRBD2*01 | 1540 | tgtgccag | tttggccttggggtggc | ggactagccgg | tac | caatgagcagttcttc | 3236 | C A S L A L G W R T S G T N E Q F F |
| 28.13 | TRBV28*01 | TRBJ2-1*01 | TRBD2*02 | 1541 | tgtgccagca | tgg | ctagccgga | agg | atgagcagttcttc | 3237 | C A S M A S G K D E Q F F |
| 28.14 | TRBV28*01 | TRBJ2-1*01 | TRBD1*01 | 1542 | tgtgccagca | ataga | ggacag | tccttggg | gagcagttcttc | 3238 | C A S N R G Q S F G E Q Y F |
| 28.15 | TRBV28*01 | TRBJ2-7*01 | TRBD2*01 | 1543 | tgtgccagc | caatcc | gggactagccgg | ag | acgagcagtactc | 3239 | C A S Q S G T S G D E Q Y F |
| 28.16 | TRBV28*01 | TRBJ2-7*01 | TRBD1*01 | 1544 | tgtgccagcag | ggct | acaggg | tctgaaaaccatatttt | | 3240 | C A S R A T G S G N T I Y F |
| 28.17 | TRBV28*01 | TRBJ2-7*01 | TRBD1*01 | 1545 | tgtgccagcag | gggaa cc gggacag | ccatcc | acgacgagtactc | | 3241 | C A S R G T G T A I H E Q Y F |
| 28.18 | TRBV28*01 | TRBJ2-7*01 | TRBD1*01 | 1546 | tgtgccagcag | gatt | gacaggg | cc ag ctcctacgagcagtactc | | 3242 | C A S R I D R A S S Y E Q Y F |

Figure 1-57

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 28.19 | TRBV28*01 | TRBJ2-1*01 | TRBD1*01 | 1547 | tgtgccagcag | aatc | gacag | ctcctacaatgagcagttcttc | | 3243 | C A S R I D S S Y N E Q F F |
| 28.20 | TRBV28*01 | TRBJ1-2*01 | TRBD1*01 | 1548 | tgtgccagcag | accacc | caggg | cgg | ctatgctacacctc | 3244 | C A S R P P Q G G Y G Y T F |
| 28.21 | TRBV28*01 | TRBJ2-5*01 | TRBD1*01 | 1549 | tgtgccagcag | gaggat | ggacagg | cagattgct | gagaccagtactc | 3245 | C A S R R M D R Q I A E T Q Y F |
| 28.22 | TRBV28*01 | TRBJ2-1*01 | TRBD2*01 | 1550 | tgtgccagcag | gtcct | cggg | tatgg | atgagcagttcttc | 3246 | C A S R S S G M D E Q F F |
| 28.23 | TRBV28*01 | TRBJ1-1*01 | TRBD2*02 | 1551 | tgtgccagcag | aacac | agcgggagg | caa | acaatgagcagttcttc | 3247 | C A S R T Q R E A N N E Q F F |
| 28.24 | TRBV28*01 | TRBJ2-2*01 | TRBD1*01 | 1552 | tgtgccagc | cgctactt | cc gggacagg | | ccgggagctgtttt | 3248 | C A S R Y F R D R A G E L F F |
| 28.25 | TRBV28*01 | TRBJ2-3*01 | TRBD1*01 | 1553 | tgtgccagcagt | gaaaggaaa | c gggaca | aactaca | cacagatacgcagtattt | 3249 | C A S S E R K R D K L H T D T Q Y F |
| 28.26 | TRBV28*01 | TRBJ1-1*01 | TRBD1*01 | 1554 | tgtgccagcagttt | c | gacag | ct | tgaacactgaagcttc | 3250 | C A S S F D S L N T E A F F |
| 28.27 | TRBV28*01 | TRBJ2-7*01 | TRBD1*01 | 1555 | tgtgccagcagttt | tttt | ggacaggggc | ca | acgagcagtactc | 3251 | C A S S F F G Q G A N E Q Y F |
| 28.28 | TRBV28*01 | TRBJ2-1*01 | TRBD2*02 | 1556 | tgtgccagcagttt | t | ggaggg | | gagcagttcttc | 3252 | C A S S F G G E Q F F |
| 28.29 | TRBV28*01 | TRBJ2-7*01 | | 1557 | tgtgccagcagttt | | tggcatcctga | | cctacgagcagtactc | 3253 | C A S S F G I L T Y E Q Y F |
| 28.30 | TRBV28*01 | TRBJ2-1*01 | TRBD2*02 | 1558 | tgtgccagcagttt | ct | tagcggaggg | tcagg | caatgagcagttcttc | 3254 | C A S S F L A G G S G N E Q F F |
| 28.31 | TRBV28*01 | TRBJ1-2*01 | TRBD1*01 | 1559 | tgtgccagcagttt | taatt | caggg | | aactatgctacacctc | 3255 | C A S S F N S G N Y G Y T F |
| 28.32 | TRBV28*01 | TRBJ2-7*01 | TRBD1*01 | 1560 | tgtgccagcagt | cca | gggacaggggc | actttcg | cctacgagcagtactc | 3256 | C A S S F Q G G A L F A Y E Q Y F |
| 28.33 | TRBV28*01 | TRBJ1-1*01 | TRBD1*01 | 1561 | tgtgccagcagttt | ccaa | acagggg | c g gg | actgaagcttctt | 3257 | C A S S F Q T G G T E A F F |
| 28.34 | TRBV28*01 | TRBJ2-3*01 | | 1562 | tgtgccagcagttt | ttcgcgtacgc | gcacagatacgcagtatttt | | | 3258 | C A S S F S R T R T D T Q Y F |
| 28.35 | TRBV28*01 | TRBJ2-1*01 | TRBD2*01 | 1563 | tgtgccagcagttt | ctggcgct | cggggg | | aatgagcagttcttc | 3259 | C A S S F W R S G N E Q F F |
| 28.36 | TRBV28*01 | TRBJ2-7*01 | TRBD1*01 | 1564 | tgtgccagcag | tt cc gggacaggggg | | ctacgagcagtactc | | 3260 | C A S S G T G G Y E Q Y F |
| 28.37 | TRBV28*01 | TRBJ2-7*01 | TRBD1*01 | 1565 | tgtgccagcagt | ata | gacaggg | aagtgcg | ctacgagcagtactc | 3261 | C A S S I D R E V R Y E Q Y F |
| 28.38 | TRBV28*01 | TRBJ2-1*01 | TRBD2*01 | 1566 | tgtgccagcagt | a | tag | aa | gagcagttcttc | 3262 | C A S S I E E Q F F |
| 28.39 | TRBV28*01 | TRBJ2-7*01 | | 1567 | tgtgccagcagtta | gctcgccaga | acgagcagtactc | | | 3263 | C A S S L A R Q N E Q Y F |
| 28.40 | TRBV28*01 | TRBJ2-5*01 | TRBD1*01 | 1568 | tgtgccagcagt | ct ggacagg | cccgaa | aagagaccagtactc | | 3264 | C A S S L D R A R K E T Q Y F |
| 28.41 | TRBV28*01 | TRBJ1-2*01 | | 1569 | tgtgccagcagtta | gagccattgg | atgcctacacctc | | | 3265 | C A S S L E P L D G Y T F |
| 28.42 | TRBV28*01 | TRBJ2-2*01 | TRBD2*02 | 1570 | tgtgccagcagt | ct | ggagg tgtgg | | ggggagctgtttt | 3266 | C A S S L E V W G E L F F |
| 28.43 | TRBV28*01 | TRBJ2-1*01 | TRBD2*02 | 1571 | tgtgccagcagtta | ggga | tagcggagg | ct | atgagcagttcttc | 3267 | C A S S L G I A G G Y E Q F F |
| 28.44 | TRBV28*01 | TRBJ2-5*01 | | 1572 | tgtgccagcagtta | gcccg | agagaccagtactc | | | 3268 | C A S S L G R E T Q Y F |
| 28.45 | TRBV28*01 | TRBJ2-1*01 | TRBD1*01 | 1573 | tgtgccagcagtta | gg | gggacaggg | acg | tacaatgagcagttcttc | 3269 | C A S S L G T G T Y N E Q F F |
| 28.46 | TRBV28*01 | TRBJ2-7*01 | TRBD2*01 | 1574 | tgtgccagcagtta | gg | cta | t | tcctacgagcagtactc | 3270 | C A S S L G Y S Y E Q Y F |

Figure 1-58

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 28.47 | TRBV28*01 | TRBJ2-7*01 | TRBD2*02 | 1575 | tgtgccagcagt... | cttaaaaa... | gggag... | aaat... | ctacgagcagtactlc | 3271 | C A S S L K K G E I Y E Q Y F |
| 28.48 | TRBV28*01 | TRBJ2-7*01 | TRBD2*01 | 1576 | tgtgccagcagtt... | g ...ctag... | acct | ...cgagcagtacttc | | 3272 | C A S S L L L D L E Q Y F |
| 28.49 | TRBV28*01 | TRBJ2-7*01 | TRBD2*02 | 1577 | tgtgccagcagtt... | gttggt | ...aggg ctgtg . | tcctacgagcagtacttc | | 3273 | C A S S L L G R A V S Y E Q Y F |
| 28.50 | TRBV28*01 | TRBJ2-6*01 | TRBD2*01 | 1578 | tgtgccagcagtta.. | ctaca ...... | tagcg...... c | ctctggggccaacgtcctgacttc | | 3274 | C A S S L L H S A S G A N V L T F |
| 28.51 | TRBV28*01 | TRBJ2-7*01 | TRBD2*01 | 1579 | tgtgccagcagtta.. | claaggacc... | agcagggg... | ...tacgagcagtacttc | | 3275 | C A S S L L R D Q R G Y E Q Y F |
| 28.52 | TRBV28*01 | TRBJ1-2*01 | | 1580 | tgtgccagcagtta.. | aacatgt ...ctatggctacacctc | | | | 3276 | C A S S L N M V Y G Y T F |
| 28.53 | TRBV28*01 | TRBJ2-2*01 | | 1581 | tgtgccagcagt..... | ct . gaacaccgggagctgttttt | | | | 3277 | C A S S L N T G E L F F |
| 28.54 | TRBV28*01 | TRBJ1-2*01 | TRBD2*02 | 1582 | tgtgccagcagtta.. | c ........ cggga... a | ........ gctacacctc | | | 3278 | C A S S L P G S Y T F |
| 28.55 | TRBV28*01 | TRBJ1-1*01 | TRBD1*01 | 1583 | tgtgccagcag...... | cctccaa gggacaggg... | tgg .. | .actgaagcttctt | | 3279 | C A S S L Q G T G W T E A F F |
| 28.56 | TRBV28*01 | TRBJ2-7*01 | TRBD1*01 | 1584 | tgtgccagcagtta.. | cagggg... | tacc .. | cctacgagcagtacttc | | 3280 | C A S S L Q G Y P Y E Q Y F |
| 28.57 | TRBV28*01 | TRBJ2-3*01 | TRBD1*01 | 1585 | tgtgccagcagtttat. | ctat ... gggg. t | ...cagatacgcagtattt | | | 3281 | C A S S L M G S D T Q Y F |
| 28.58 | TRBV28*01 | TRBJ2-3*01 | | 1586 | tgtgccagcagtta.. | ...acagatacgcagtattt | | | | 3282 | C A S S L T D T Q Y F |
| 28.59 | TRBV28*01 | TRBJ2-3*01 | TRBD2*01 | 1587 | tgtgccagcagtta.. | ...actacgcgggg... | atact ct | agcacagatacgcagtattt | | 3283 | C A S S L T S G G Y S S T D T Q Y F |
| 28.60 | TRBV28*01 | TRBJ2-7*01 | TRBD2*02 | 1588 | tgtgccagcagtta.. | gtg ...gcggag.. | aacct .. | ..tacgagcagtactlc | | 3284 | C A S S L V A G E P Y E Q Y F |
| 28.61 | TRBV28*01 | TRBJ2-7*01 | | 1589 | tgtgccagcagtta.. | gtcttgtt ...tacgagcagtacttc | | | | 3285 | C A S S L V L V Y E Q Y F |
| 28.62 | TRBV28*01 | TRBJ2-3*01 | TRBD1*01 | 1590 | tgtgccagcagtttatg | .......ggc | agcacagatacgcagtattt | | | 3286 | C A S S L W G S T D T Q Y F |
| 28.63 | TRBV28*01 | TRBJ2-7*01 | TRBD1*01 | 1591 | tgtgccagcagtttatg g | gggaca..... | cta ...tacgagcagtactlc | | | 3287 | C A S S L W G T L Y E Q Y F |
| 28.64 | TRBV28*01 | TRBJ2-1*01 | TRBD1*01 | 1592 | tgtgccagcagt..... | at . gacaggg... | acctt .. | ..caatgagcagttcttc | | 3288 | C A S S M T G T F N E Q F F |
| 28.65 | TRBV28*01 | TRBJ1-5*01 | TRBD1*01 | 1593 | tgtgccagcagt..... | c ... caggg... | atcgacct | ..caatcagcccagcatt | | 3289 | C A S S P G I D L N Q P Q H F |
| 28.66 | TRBV28*01 | TRBJ2-7*01 | TRBD2*01 | 1594 | tgtgccagcag...... | ccc gggactagcg..... | ac . | ......cgagcagtacttc | | 3290 | C A S S P G L A T E Q Y F |
| 28.67 | TRBV28*01 | TRBJ2-7*01 | TRBD2*02 | 1595 | tgtgccagcag...... | cccatgggggg ...ctagcgggag.. t | ...ctacgagcagtactlc | | | 3291 | C A S S P M G G L A G V Y E Q Y F |
| 28.68 | TRBV28*01 | TRBJ1-6*01 | TRBD1*01 | 1596 | tgtgccagcag...... | cccaccg... | agggg... | taattcaccctccactt | | 3292 | C A S S P P G G G N S P L H F |
| 28.69 | TRBV28*01 | TRBJ1-1*01 | TRBD1*01 | 1597 | tgtgccagcagt..... | cca ccc gggacagggg.. | ttctagg... | cactgaagcttcttt | | 3293 | C A S S P P G T G V L G T E A F F |
| 28.70 | TRBV28*01 | TRBJ1-2*01 | TRBD1*01 | 1598 | tgtgccagcagt..... | cccaga gggaca.. | tt . | ...ctatgctacacctc | | 3294 | C A S S P R G T F Y G Y T F |
| 28.71 | TRBV28*01 | TRBJ2-5*01 | TRBD1*01 | 1599 | tgtgccagcagt..... | ccct cc gggacaggg.. | ttg . | ....gagaccagtactlc | | 3295 | C A S S P S G T G L E T Q Y F |
| 28.72 | TRBV28*01 | TRBJ2-7*01 | TRBD1*01 | 1600 | tgtgccagcagt..... | cc ..gacagg... | tcttt . | ......cgagcagtacttc | | 3296 | C A S S P T G S F E Q Y F |
| 28.73 | TRBV28*01 | TRBJ1-2*01 | TRBD1*01 | 1601 | tgtgccagcag...... | cccta cc gggaca..... | aaaa . | ...atggctacacctc | | 3297 | C A S S P T G T K N G Y T F |
| 28.74 | TRBV28*01 | TRBJ2-7*01 | TRBD1*01 | 1602 | tgtgccagcag...... | cca ..gacaggg... | cgg . | ..cctacgagcagtacttc | | 3298 | C A S S Q T G A A Y E Q Y F |

Figure 1-59

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 28.75 | TRBV28*01 | TRBJ2-2*01 | TRBJ2-2*01 | 1603 | tgtgccagcag | cc | gcggggg | agagg | acacgggagctgttttt | 3299 | C A S S R G G E D T G E L F F |
| 28.76 | TRBV28*01 | TRBJ2-1*01 | TRBD2*01 | 1604 | tgtgccagcag | cagaa | tagcg | atatg | aatgagcagttcttc | 3300 | C A S S R I A D M N E Q F F |
| 28.77 | TRBV28*01 | TRBJ2-5*01 | TRBD2*02 | 1605 | tgtgccagcag | cagatt | gcggga | acgggg | agagaccccagtactc | 3301 | C A S S R L R E R G E T Q Y F |
| 28.78 | TRBV28*01 | TRBJ1-5*01 | TRBD1*01 | 1606 | tgtgccagcag | cte | ggacaggg | taagg | aatcagcccagcattt | 3302 | C A S S D R V R N Q P Q H F |
| 28.79 | TRBV28*01 | TRBJ2-7*01 | TRBD1*01 | 1607 | tgtgccagcagtt | caata | gggacag | | cctacgagcagtactc | 3303 | C A S S I G T A Y E Q Y F |
| 28.80 | TRBV28*01 | TRBJ2-3*01 | TRBD1*01 | 1608 | tgtgccagcagtt | cct cc | gggaca | caaaa | cacagatacgcagtatttt | 3304 | C A S S S G T Q N T D T Q Y F |
| 28.81 | TRBV28*01 | TRBJ1-4*01 | TRBD1*01 | 1609 | tgtgccagcag | ctc | gacaggg | ttttcc | gaaaaactgttttt | 3305 | C A S S S T G F S E K L F F |
| 28.82 | TRBV28*01 | TRBJ2-3*01 | TRBD2*01 | 1610 | tgtgccagcagtt | cct | ggactagcg | aga | cacagatacgcagtattt | 3306 | C A S S S W T S G D T D T Q Y F |
| 28.83 | TRBV28*01 | TRBJ2-1*01 | TRBD2*02 | 1611 | tgtgccagcagt | | acggtccag | | aatgagcagttcttc | 3307 | C A S S T V Q N E Q F F |
| 28.84 | TRBV28*01 | TRBJ2-1*01 | TRBD2*01 | 1612 | tgtgccagcagt | gggact | | tc ag ctcctacaatgagcagttcttc | | 3308 | C A S S W D F S S Y N E Q F F |
| 28.85 | TRBV28*01 | TRBJ2-7*01 | TRBD2*01 | 1613 | tgtgccagcagt | | gggggg aaag | | gagcagtactc | 3309 | C A S S W G G K E Q Y F |
| 28.86 | TRBV28*01 | TRBJ2-7*01 | TRBD1*01 | 1614 | tgtgccagcagtt | g | gggacagg | tttc | cgagcagtactc | 3310 | C A S S W G Q V S E Q Y F |
| 28.87 | TRBV28*01 | TRBJ2-7*01 | TRBD2*02 | 1615 | tgtgccagcagtt | at | ctagccggga | | cctacgagcagtactc | 3311 | C A S S Y L A G A Y E Q Y F |
| 28.88 | TRBV28*01 | TRBJ2-7*01 | TRBD2*02 | 1616 | tgtgccagca | ccgat | ggactagcgggag | | cctacgagcagtactc | 3312 | C A S T D G L A G A Y E Q Y F |
| 28.89 | TRBV28*01 | TRBJ1-1*01 | TRBD1*01 | 1617 | tgtgccagca | cgata | acag | a | gaacactgaagcttctt | 3313 | C A S T I T E N T E A F F |
| 28.90 | TRBV28*01 | TRBJ2-7*01 | TRBD2*02 | 1618 | tgtgccagca | cottgggc | ctagcggga | cccc | cctacgagcagtactc | 3314 | C A S T L G L A G P P Y E Q Y F |
| 28.91 | TRBV28*01 | TRBJ2-7*01 | TRBD2*01 | 1619 | tgtgcca | ccaggttcatg | gcggg | tccaaccc | acgagcagtactc | 3315 | C A T R F M A G P T H E Q Y F |
| 28.92 | TRBV28*01 | TRBJ2-2*01 | TRBD2*02 | 1620 | tgtgcca | ccagtgatccga | | aggg cagaaa | aacaccgggagctgtttt | 3316 | C A T S D P E G Q K N T G E L F F |
| 28.93 | TRBV28*01 | TRBJ2-3*01 | TRBD2*02 | 1621 | tgtgcca | ccagtcg | tagccggag | cttg | acagatacgcagtatttt | 3317 | C A T S R S G S L T D T Q Y F |
| 29.01 | TRBV29-1*01 | TRBJ1-4*01 | TRBD1*01 | 1622 | tgcagcg | ct gggacagg | tggc | actaatgaaaaactgtttt | | 3318 | C S A G T G G T N E K L F F |
| 29.02 | TRBV29-1*03 | TRBJ2-7*01 | TRBD1*01 | 1623 | tgcagcgc | cc | gacaggg | agcg | cctacgagcagtactc | 3319 | C S A R Q G S A Y E Q Y F |
| 29.03 | TRBV29-1*03 | TRBJ2-1*01 | TRBD2*01 | 1624 | tgcagcg | gggagggcagtc | gactagcgggg | ttcg | atgagcagttctc | 3320 | C S G E G R S T S G G F D E Q F F |
| 29.04 | TRBV29-1*03 | TRBJ2-5*01 | TRBD2*02 | 1625 | tgcagc | acaa | gactagcgggag | agcg | ccaagagaccagtactc | 3321 | C S T R L A G E R Q E T Q Y F |
| 29.05 | TRBV29-1*01 | TRBJ2-4*01 | TRBD2*01 | 1626 | tgcagcgt | cgct | gact | ctattgagccaaaaacattcagtactc | | 3322 | C S V A D S I G A K N I Q Y F |
| 29.06 | TRBV29-1*03 | TRBJ2-7*01 | TRBD2*02 | 1627 | tgcagcg | tcg | ctagcggga | ccgg | ctacgagcagtactc | 3323 | C S V A S G T G Y E Q Y F |
| 29.07 | TRBV29-1*03 | TRBJ2-5*01 | TRBD2*01 | 1628 | tgcagcg | ttgatccgacgggt | | cgggg | ccaagagaccagtactc | 3324 | C S V D P T G R G Q E T Q Y F |
| 29.08 | TRBV29-1*03 | TRBJ2-4*01 | TRBD1*01 | 1629 | tgcagcg | t ggacaggg | cg | aaaacattcagtactc | | 3325 | C S V D R G E N I Q Y F |

Figure 1-60

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 29.09 | TRBV29-1*01 | TRBJ1-1*01 | TRBD1*01 | 1630 | tgcagcgt...... | a ...gacag..... | .gaacactgaagcttcatt | | | 3326 | C S V D R N T E A F F |
| 29.10 | TRBV29-1*03 | TRBJ2-1*01 | TRBD1*01 2 | 1631 | tgcagcg..... | ttgattct .....agggg. | ctcctacaatgagcagttcttc | | | 3327 | C S V D S R G S Y N E Q F F |
| 29.11 | TRBV29-1*03 | TRBJ2-3*01 | TRBD1*01 | 1632 | tgcagcg..... | ttgacgtc ..cagtag..... | ccgt ...acagatacgcagtatttt | | | 3328 | C S V D V Q G R T D T Q Y F |
| 29.12 | TRBV29-1*01 | TRBJ2-1*01 | TRBD1*01 | 1633 | tgcagcgttgaag. | cagtca .ggac....... cct | ........gttcttc | | | 3329 | C S V E A V R T L F F |
| 29.13 | TRBV29-1*01 | TRBJ2-2*01 | TRBD2*01 | 1634 | tgcagcgttgaag. | cgtggg ......agcgggg..... | gaacacgggagctgttttt | | | 3330 | C S V E A W E R G N T G E L F F |
| 29.14 | TRBV29-1*03 | TRBJ2-2*01 | TRBD2*02 | 1635 | tgcagcg..... | ttgaagatcga ........ | ggaggt t cgaacaccgggagctgttttt | | | 3331 | C S V E D G G G S N T G E L F F |
| 29.15 | TRBV29-1*03 | TRBJ2-5*01 | TRBD2*01 | 1636 | tgcagcg..... | ttgaagaccc ....ctagccg..... | aagt ...agagaccagtacttc | | | 3332 | C S V E D P L A E V E T Q Y F |
| 29.16 | TRBV29-1*03 | TRBJ1-2*01 | TRBD1*01 | 1637 | tgcagcg..... | ttgaagatcc ..acaggg..... | .aactatgctacacctc | | | 3333 | C S V E D P Q G N Y G Y T F |
| 29.17 | TRBV29-1*03 | TRBJ2-3*01 | TRBD2*01 | 1638 | tgcagcg..... | ttgaagactggga ....lagccg..... | aaccgccg ...cagatacgcagtatttt | | | 3334 | C S V E D W D S G T A A D T Q Y F |
| 29.18 | TRBV29-1*01 | TRBJ2-7*01 | TRBD1*01 | 1639 | tgcagcgttgaaga | a ...aca....... aa | ...ctacgagcagttc | | | 3335 | C S V E E T N Y E Q Y F |
| 29.19 | TRBV29-1*01 | TRBJ2-1*01 | TRBD1*01 | 1640 | tgcagcg..... | tcg ....agggg. ag..... | .gagcagttcttc | | | 3336 | C S V E G E E Q F F |
| 29.20 | TRBV29-1*01 | TRBJ2-6*01 | TRBD2*01 | 1641 | tgcagcgttgaag. | gaaat ggg....... | .ggggccaacgtcctgacttc | | | 3337 | C S V E G N C G A N V L T F |
| 29.21 | TRBV29-1*03 | TRBJ1-3*01 | TRBD1*01 | 1642 | tgcagcg..... | ttga .......ggggc gcc ta | ...ggaaacaccatatttt | | | 3338 | C S V E G R L G N T I Y F |
| 29.22 | TRBV29-1*01 | TRBJ2-1*01 | TRBD2*02 | 1643 | tgcagcgttgaag. | g ....tagcgggag. aa | ...cctacaatgagcagttc | | | 3339 | C S V E G S G R T Y N E Q F F |
| 29.23 | TRBV29-1*03 | TRBJ2-5*01 | TRBD1*01 | 1644 | tgcagcgttgaag. | ggacagt .ggacaggg..... | aagcgtgg ......gagacccagtacttc | | | 3340 | C S V E G T V D R E A W E T Q Y F |
| 29.24 | TRBV29-1*01 | TRBJ2-7*01 | TRBD2*01 | 1645 | tgcagcg..... | ttga ....acta....... ttca | ...acgagcagtacttc | | | 3341 | C S V E L F N E Q Y F |
| 29.25 | TRBV29-1*01 | TRBJ2-7*01 | TRBD2*01 | 1646 | tgcagcg..... | tta ........gggggg | ...cctacgagcagtacttc | | | 3342 | C S V E L G G A Y E Q Y F |
| 29.26 | TRBV29-1*03 | TRBJ2-1*01 | TRBD2*02 | 1647 | tgcagcgttgaa.. | ...actagccggagg. tt | .......caatgagcagttc | | | 3343 | C S V E T S G R F N E Q F F |
| 29.27 | TRBV29-1*01 | TRBJ2-5*01 | TRBD2*01 | 1648 | tgcagcgttga.. | ggtg ....gcgggggg. cggg | .....gagacccagtacttc | | | 3344 | C S V E V A G G G E T Q Y F |
| 29.28 | TRBV29-1*03 | TRBJ1-2*01 | | 1649 | tgcagcg..... | ttgaagttttggg taactatgctacacctc | | | | 3345 | C S V E V L G N Y G Y T F |
| 29.29 | TRBV29-1*01 | TRBJ2-1*01 | TRBD2*02 | 1650 | tgcagcgttgaa.. | tggtct .........gaggg gca ctcctacaatgagcagttc | | | | 3346 | C S V E W S E G H S Y N E Q F F |
| 29.30 | TRBV29-1*03 | TRBJ1-4*01 | TRBD1*01 | 1651 | tgcagcg..... | ttgagct ....ggggc ..actaatgaaaaactgttttt | | | | 3347 | C S V G A G G T N E K L F F |
| 29.31 | TRBV29-1*03 | TRBJ2-7*01 | TRBD1*01 | 1652 | tgcagcg..... | ttgattt ....agggg ..aaccga ...tacgagcagtacttc | | | | 3348 | C S V G F R G T G Y E Q Y F |
| 29.32 | TRBV29-1*01 | TRBJ1-2*01 | TRBD2*01 | 1653 | tgcagcgttg..... | ..ggggg. tcgtt ..ctatgctacacctc | | | | 3349 | C S V G G S F Y G Y T F |
| 29.33 | TRBV29-1*01 | TRBJ1-2*01 | TRBD2*01 | 1654 | tgcagcgttg..... | gga ........ tcgtttcgaa .....ggctacacctc | | | | 3350 | C S V G I V S E G Y T F |
| 29.34 | TRBV29-1*01 | TRBJ2-7*01 | | 1655 | tgcagcgt.......... c gggacta............cctacgagcagtactc | | | | | 3351 | C S V G T T Y E Q Y F |
| 29.35 | TRBV29-1*03 | TRBJ1-2*01 | TRBD1*01 | 1656 | tgcagcg..... | tgaa ..gacaggg..... aata ......gctacacctc | | | | 3352 | C S V K T G N S Y T F |
| 29.36 | TRBV29-1*03 | TRBJ2-1*01 | TRBD1*01 | 1657 | tgcagcg..... | ttctcggt ..acag..... aatca ag ctcctacaatgagcagttc | | | | 3353 | C S V L G T E S S Y N E Q F F |

Figure 1-61

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 29.37 | TRBV29-1*01 | TRBJ2-2*01 | TRBD2*01 | 1658 | tgcagcgtt... | ccccggtt | ggg... | ...cggggagctgttttt | | 3354 | C S V P R L G G E L F F |
| 29.38 | TRBV29-1*01 | TRBJ2-7*01 | TRBD2*01 | 1659 | tgcagcg... | taca | ggacta... | ...ctacgagcagtacttc | | 3355 | C S V Q D Y Y E Q Y F |
| 29.39 | TRBV29-1*03 | TRBJ2-2*01 | TRBD2*01 | 1660 | tgcagcg... | ...ttcaa | ...agcgg... | tt | .acaccgggagctgttttt | 3356 | C S V Q S G Y T G E L F F |
| 29.40 | TRBV29-1*03 | TRBJ2-7*01 | TRBD1*01 | 1661 | tgcagcg... | teac | ggac... | gtcagtt | ctcctacgagcagtacttc | 3357 | C S V T D V Q F S Y E Q Y F |
| 29.41 | TRBV29-1*03 | TRBJ2-3*01 | TRBD1*01 | 1662 | tgcagcg... | tgttg | gggacag... | ctt | ..cacagatacgcagtattt | 3358 | C S V V G D S F T D T Q Y F |
| 29.42 | TRBV29-1*03 | TRBJ2-7*01 | | 1663 | tgcagcg... | | tgttagttgcg | | .cctacgagcagttcttc | 3359 | C S V V S G A Y E Q Y F |
| 29.43 | TRBV29-1*01 | TRBJ2-7*01 | TRBD2*01 | 1664 | tgcagcgtt... | t | ......ggggggg | gggaag | ...ctacgagcagtacttc | 3360 | C S V W G G G S Y E Q F F |
| 30.01 | TRBV30*01 | TRBJ2-1*01 | TRBD2*01 | 1665 | tgtgcctg... | cc | gggact... | cgggg | ......aatgagcagttcttc | 3361 | C A C R D S G N E Q F F |
| 30.02 | TRBV30*01 | TRBJ2-7*01 | TRBD1*01 | 1666 | tgtgcc... | | cgaggct... | ggggg | .aacg....acgagcagtacttc | 3362 | C A R G W G N D E Q Y F |
| 30.03 | TRBV30*01 | TRBJ2-1*01 | | 1667 | tgtgcctgg... | gacgga | .....tacaatgagcagttcttc | | | 3363 | C A W D G Y N E Q F F |
| 30.04 | TRBV30*01 | TRBJ2-3*01 | TRBJ2-3*01 | 1668 | tgtgcctg... | ...ggc | tt | ...agatacgcagtattt | | 3364 | C A W G L D T Q Y F |
| 30.05 | TRBV30*01 | TRBJ2-3*01 | TRBD1*01 | 1669 | tgtgcctg... | ...ggc | ttaa | ...atacgcagtattt | | 3365 | C A W G L N T Q Y F |
| 30.06 | TRBV30*01 | TRBJ2-7*01 | TRBD1*01 | 1670 | tgtgcctga... | aatt | .gacaggg... | ct | ..ctacgagcagtacttc | 3366 | C A W K L T G L Y E Q Y F |
| 30.07 | TRBV30*01 | TRBJ2-5*01 | TRBD2*02 | 1671 | tgtgcctga... | atgtaca | ...agcggga... | a | ...aagagacccagttcttc | 3367 | C A W N V Q A G K E T Q Y F |
| 30.08 | TRBV30*01 | TRBJ2-1*01 | TRBD1*01 | 1672 | tgtgcctgag... | ag | cc | gggacaggggg... | tg | ......aatgagcagttcttc | 3368 | C A W R A G T G V N E Q F F |
| 30.09 | TRBV30*01 | TRBJ2-7*01 | TRBD2*01 | 1673 | tgtgcctgag... | aaaa | ....tagcggg... | | gagcagtacttc | 3369 | C A W R N S G E Q Y F |
| 30.10 | TRBV30*01 | TRBJ2-1*01 | TRBD2*01 | 1674 | tgtgcctgag... | aactct | ...tagcgggg... | cg | ...tacaatgagcagttcttc | 3370 | C A W R T L S G A Y N E Q F F |
| 30.11 | TRBV30*01 | TRBJ1-1*01 | TRBD1*01 | 1675 | tgtgcctgagtg. | ca | .gaca... | tgaacactgaagcttcttt | | 3371 | C A W S A D M N T E A F F |
| 30.12 | TRBV30*01 | TRBJ2-5*01 | TRBD1*01 | 1676 | tgtgcctgag... | cgacgt | ggga... | ......agaccccagtactc | | 3372 | C A W S D G G K T Q Y F |
| 30.13 | TRBV30*01 | TRBJ2-1*01 | | 1677 | tgtgcctgagtg. | aagglaacc | ....atgagcagttcttc | | | 3373 | C A W S E G N H E Q Y F |
| 30.14 | TRBV30*01 | TRBJ2-3*01 | TRBD1*01 | 1678 | tgtgcctgagtg. | gggacag... | attcca | ....agatacgcagtattt | | 3374 | C A W S G D R F Q D T Q Y F |
| 30.15 | TRBV30*01 | TRBJ2-1*01 | TRBD2*01 | 1679 | tgtgcctgagtg. | ga | ...actag... | ctcaatgagcagttcttc | | 3375 | C A W S G T S Y N E Q F F |
| 30.16 | TRBV30*01 | TRBJ2-7*01 | | 1680 | tgtgcctgagtg. | g | ...ctacgagcagtacttc | | | 3376 | C A W S G Y E Q Y F |
| 30.17 | TRBV30*01 | TRBJ2-7*01 | TRBD1*01 | 1681 | tgtgcctgagt. | aaaa | cc | gggacaggg... | .....acgagcagtacttc | 3377 | C A W S K T G T G D E Q Y F |
| 30.18 | TRBV30*01 | TRBJ2-1*01 | TRBD2*02 | 1682 | tgtgcctggagt. | cct | ...actagcgggaagg | .......aatgagcagttcttc | | 3378 | C A W S P T S G R N E Q F F |
| 30.19 | TRBV30*01 | TRBJ2-3*01 | TRBD1*01 | 1683 | tgtgcctgag... | cc | gggacag... | tg | .gcacagatacgcagtattt | 3379 | C A W S R D S G T D T Q Y F |
| 30.20 | TRBV30*01 | TRBJ2-7*01 | TRBD2*01 | 1684 | tgtgcctgagt. | agttttcgg | gggactagcggg... | t | .tcctacgagcagtacttc | 3380 | C A W S S F G G L A G S Y E Q Y F |

Figure 1-62

| clone # | V name | J name | D name | SEQ ID NO: | V-REGION | N1 | D-REGION | (P) N2 | J-REGION | SEQ ID NO: | CDR3 amino acid |
|---|---|---|---|---|---|---|---|---|---|---|---|
| 30.21 | TRBV30*01 | TRBJ1-1*01 | TRBD1*01 | 1685 | tgtgcctggagt. | ...acaggggc gcg | | ...actgaagcttcttt | | 3381 | C A W S T G G A T E A F F |
| 30.22 | TRBV30*01 | TRBJ2-1*01 | TRBD1*01 | 1686 | tgtgcctggagtgt a | gggacaggggg. | att | ....... tgagcagttcttc | | 3382 | C A W S V G T G G F E Q F F |
| 30.23 | TRBV30*01 | TRBJ2-5*01 | TRBD2*02 | 1687 | tgtgcctggagtgt aca | ......agcggga. | .....aaagagaccat | ........tacttc | | 3383 | C A W S V Q A G K E T H Y F |
| 30.24 | TRBV30*01 | TRBJ2-5*01 | TRBD2*02 | 1688 | tgtgcctggagtgt aca | ......agcggga... a | ...aagagaccagtactc | | | 3384 | C A W S V Q A G K E T Q Y F |
| 30.25 | TRBV30*01 | TRBJ1-2*01 | TRBD2*02 | 1689 | tgtgcctggagtgt aca | agggtatt | ......gggagg. tcc | ..actatgctacaccttc | | 3385 | C A W S V Q G Y W E V H Y G Y T |
| 30.26 | TRBV30*05 | TRBJ2-7*01 | TRBD2*02 | 1690 | gtgtcctgg... agtgtacaac | .......cggga... | aaagaaaccct | ...........tacttc | | 3386 | C A W S V Q P G K E T P Y F |
| 30.27 | TRBV30*01 | TRBJ2-1*01 | TRBD2*01 | 1691 | tgtgcctggagtgt acaa | ....agcggg... tccc | .......atgacagttcttc | | | 3387 | C A W S V Q S G S H E Q F F |
| 30.28 | TRBV30*05 | TRBJ2-7*01 | | 1692 | tgtgcctgg... agtgtatcggtgaagcct | ......cgagcagtacttc | | | | 3388 | C A W S V S V S L E Q Y F |
| 30.29 | TRBV30*01 | TRBJ2-2*01 | TRBD2*02 | 1693 | tgtgcctggagtgt aa | ........cggga... ttcccacc | .. caccggggaagctgttttt | | | 3389 | C A W S V T G F P P T G E L F F |
| 30.30 | TRBV30*01 | TRBJ1-2*01 | TRBD1*01 | 1694 | tgtgcctggagtgt agt | .....gggg. gggggaatgttacc | ..........cctc | | | 3390 | C A W S V V G G G N G Y P F |
| 30.31 | TRBV30*02 | TRBJ1-1*01 | | 1695 | tgtgcctgg..... gtataccgcgcagct | ..aacactgaagcttcttt | | | | 3391 | C A W V Y R A A N T E A F F |
| 30.32 | TRBV30*01 | TRBJ2-5*01 | TRBD1*01 | 1696 | tgt............cctccgg ...caggggcg gccc gggagggccg | ....gagaccagtacttc | | | | 3392 | C P S G R G R P G G P E T Q Y F |

CANCER ANTIGEN-SPECIFIC T-CELL RECEPTOR GENE, PEPTIDE ENCODED BY THE GENE, AND USE OF THEM

SEQUENCE LISTING

The instant application contains a Sequence Listing which has been submitted electronically in ASCII format and is hereby incorporated by reference in its entirety. Said ASCII copy, created on Feb. 14, 2017, is named 05273 0120-02000 SL.txt. and is 582,500 bytes in size.

TECHNICAL FIELD

The present invention relates to a polynucleotide contained in the gene for a cancer antigen-specific T-cell receptor, and the peptide encoded by the polynucleotide, and to cancer tests, e.g., diagnosis, prognosis, or treatment monitoring using the same, cancer therapy, and the like.

BACKGROUND ART

Cancer treatments include extirpation of cancer by surgical operation, radiotherapy, treatment with anti-cancer medication, and immunotherapy. Among these treatments, immunotherapy in particular has drawn attention in recent years because it is a treatment more selective and specific against cancer with least side effects. Inter alia, attempts have been extensively made to treat cancer and leukemia by targeting WT1 protein, which is abundantly present in many types of cancer cells and leukemia cells. In order to study the mechanism of the WT1-targeted anti-cancer therapy and to further increase the effect of the therapy, it is necessary to identify the nucleotide sequences of the T-cell receptor (TCR) genes of WT1-specific cytotoxic T-cells (CTL) and the amino acid sequences of the receptor peptides encoded by the nucleotide sequences. However, up to the present date, little is known about the sequences of those receptor genes and the receptor peptides, let alone that no effective use of them has been described, although a number of researches have been conducted (see, e.g., non-patent documents 1-5).

Non-Patent Document 1: Valmori D. et al., J. Immunol. 168: 4231-4240, 2002
Non-Patent Document 2: Dietrich P.Y. et al., Cancer Res. 61: 2047-2054, 2001
Non-Patent Document 3: Coulie P.G. et al., Proc. Natl. Acad. Sci. U.S.A. 98: 10290-10295, 2001
Non-Patent Document 4: Godelaine D. et al. J. Immunol. 171: 4893-4897, 2003
Non-Patent Document 5: Mandruzzato S. et al., J. Immunol. 169: 4017-4024, 2002

SUMMARY OF THE INVENTION

An object of the present invention was to reveal the amino acid sequences of T-cell receptors (TCRs) of WT1-specific cytotoxic T-cells (CTLs) for WT1 protein, and the nucleotide sequences of the genes encoding them, in particular, the amino acid and nucleotide sequences of the CDR3 region of them, as well as to use those pieces of information in cancer tests (diagnosis, prognosis, treatment monitoring, or the like) and in cancer therapy.

DISCLOSURE OF INVENTION

Problems to be Solved by the Invention

To accomplish the above object, the present inventors have conducted extensive research and determined, for the first time, the nucleotide and amino acid sequences of CD3 of the Vβ chain of T-cell receptors (TCRs) of WT1-specific cytotoxic T-cells (CTLs) from healthy individuals and HLA-A*2402-positive patients, and have thereby completed the present invention.

Thus, the present invention provides the following:
(1) A polynucleotide having a nucleotide sequence encoding CDR3 of a Vβ chain of a T-cell receptor (TCR) of a WT1-specific cytotoxic T-cell (CTL), said polynucleotide having DNA having any of the CDR3 nucleotide sequences shown in SEQ ID Nos.: 1-1696, RNA complementary to the DNA, or a polynucleotide having a complementary sequence thereof;
(2) The polynucleotide according to (1), wherein said polynucleotide consists of a DNA comprising any of the CDR3 nucleotide sequences shown in SEQ ID Nos.: 1-1696, or an RNA complementary thereto, or complementary sequences thereof;
(3) A peptide having an amino acid sequence of CDR3 of a Vβ chain of a T-cell receptor (TCR) of a WT1-specific cytotoxic T-cell (CTL), said peptide having any of the amino acid sequences of CDR3 shown in SEQ ID Nos.: 1697-3392;
(4) The peptide according to (3) consisting of any of the amino acid sequences of CDR3 shown in SEQ ID Nos.: 1697-3392;
(5) Use of the polynucleotide of (1) or (2), or the peptide of (3) or (4) as a cancer marker;
(6) A method for diagnosing cancer in an HLA-A*2402-positive patient, which comprises assessing the clonality of a WT1-specific CTL having any of the polynucleotides of (1) or (2), or any of the peptides of (3) or (4) in a sample obtained from the patient before therapy, wherein when a WT1-specific CTL having a multiplicity of clonality is present, the patient is determined to have a possibility of having cancer;
(7) The method according to (6), wherein a higher possibility of developing cancer in the patient before therapy is determined when the clonality of a WT1-specific CTL having any of the CDR3 polynucleotides or any of the CDR3 peptides and having the clonality of 3 or more is higher, or when the types of a WT1-specific CTL having the clonality of 3 or more are more abundant;
(8) A method for testing for sensitivity of an HLA-A*2402-positive patient to WT1 peptide immunotherapy, which comprises assessing the clonality and the number of types of WT1-specific CTLs having any of the polynucleotides of (1) or (2) or any of the peptides of (3) or (4) in a sample obtained from the patient before therapy, wherein the patient is determined to have sensitivity to WT1 peptide immunotherapy when the types of WT1-specific CTLs with a multiplicity of clonality are more abundant in the patient than in a subject non-responsive to the therapy;
(9) The method according to (8), wherein a patient is determined to have higher sensitivity to WT1 peptide immunotherapy when the types of WT1-specific CTL clones with a multiplicity of clonality are more abundant, or the clonality is larger in the patient before the therapy;
(10) A method for monitoring WT1 peptide immunotherapy in an HLA-A*2402-positive patient, which comprises assessing the clonality of WT1-specific CTL clones having any of the polynucleotides of (1) or (2) or any of the peptides of (3) or (4) in a sample obtained from the patient before and after the therapy, wherein the patient is determined to have responded to WT1 peptide immunotherapy when the clonality of any of the WT1-specific CTL clones increases after the therapy compared to before the therapy;

(11) The method according to (10), wherein a patient is determined to have higher responsiveness to WT1 peptide immunotherapy when the larger becomes the increase rate in the clonality, or the more abundant become the types of clones with increased clonality after the WT1 peptide immunotherapy;
(12) An antibody against the peptide of (3) or (4);
(13) A chip comprising the polynucleotide of (1) or (2), the peptide of (3) or (4), or the antibody of (12);
(14) A primer for amplifying a CDR3 polynucleotide, which has a sequence selected from the sequences shown in SEQ ID Nos.: 3394-3421.
(15) A kit for diagnosing cancer, a kit for testing for sensitivity of a patient to WT1 peptide immunotherapy, or a kit for monitoring WT1 peptide immunotherapy, comprising means for detecting a WT1-specific CTL having the polynucleotide of (1) or (2) or the peptide of (3) or (4);
(16) A device for cancer diagnosis, a device for testing for sensitivity of a patient to WT1 peptide immunotherapy, or a device for monitoring WT1 peptide immunotherapy, comprising means for detecting a WT1-specific CTL having the polynucleotide of (1) or (2) or the peptide of (3) or (4);
(17) The kit according to (15), comprising the chip of (13) or the primer of (14);
(18) The device according to (16), wherein the chip of (13) or the primer of (14) is used in the device;
(19) A lymphocyte of an HLA-A*2402-positive cancer patient, into which a T-cell receptor gene comprising a sequence of the polynucleotide of (1) or (2) is introduced.

The present invention also provides cancer therapy using lymphocytes from HLA-A*2402-positive patients, wherein a T-cell receptor gene containing a CDR3 polynucleotide is introduced into the lymphocytes.

Further, the present invention provides an antibody raised against a CDR3 polypeptide and use thereof.

Effect of the Invention

By virtue of the present invention, the nucleotide sequences contained in the gene for the Vβ chain of T-cell receptors (TCRs) of WT1-specific cytotoxic T-cells (CTLs), and the amino acid sequences of peptides encoded by them, in particular, the nucleotide and amino acid sequences of CDR3 have been revealed, and extensive cancer tests (diagnosis, prognosis, treatment monitoring, or the like), cancer therapy, and the like are enabled using these polynucleotides and peptides.

BRIEF DESCRIPTION OF DRAWINGS

FIG. 1-1 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-2 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-3 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-4 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-5 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-6 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-7 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-8 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-9 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-10 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-11 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-12 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-13 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-14 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-15 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-16 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-17 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-18 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-19 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-20 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-21 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-22 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-23 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-24 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-25 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-26 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-27 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-28 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-29 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-30 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-31 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-32 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-33 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-34 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-35 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIG. 1-36 shows the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-REGION . . . N1 . . . D-REGION . . . (P)N2 . . . J-REGION" on the nucleotide sequence indicate the origins of each portion of the nucleotide sequence.

FIGS. 1-37 to 1-62 show the nucleotide and amino acid sequences of CDR3 of the Vβ chain of T-cell receptors (TCRs) of WT1-specific cytotoxic T-cells (CTLs) from healthy individuals and HLA-A*2402-positive patients, which sequences have been identified in the present invention. In the figure, "clone #" indicates the clone numbers, the numbers to the left of the dot indicate the family numbers of Vβ chains, and the numbers to the right of the dot indicate the reference numbers. V name, J name, and D name indicate the details of the V region, J region, and D region, respectively. The letters "V-Region . . . N1 . . . D-REGION . . . (P)N2 . . . J-REGION" on the nucleotide sequence indicate the origins of each portion of the nucleotide sequence.

In FIGS. 1-1 to 1-62, the nucleotide sequences shown under "V-REGION . . . NI . . . D-REGION . . . (P) N2 . . . J-REGION" correspond to SEQ ID NOs: 1-1696 as identified in the Sequence Listing, and the amino acid sequences shown under "CDR3 amino acid" correspond to SEQ ID NOs: 1697-3392 as identified in the Sequence Listing.

FIG. 2-1 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-2 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-3 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-4 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-5 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-6 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-7 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-8 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-9 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-10 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-11 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-12 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-13 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-14 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-15 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-16 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-17 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-18 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-19 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-20 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-21 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-22 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-23 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-24 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-25 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-26 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-27 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-28 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-29 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-30 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-31 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-32 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-33 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-34 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-35 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

FIG. 2-36 shows the clonality of each clone of the WT1-specific cytotoxic T-cells (CTLs) from healthy individuals and HLA-A*2402-positive patients identified in the present invention. In the figure, "clone #" indicates the clone numbers, the numbers to the left of the dot indicate the family numbers of Vβ chains, and the numbers to the right of the dot indicate the reference numbers; HV is healthy volunteers, AML is patients with acute myelocytic leukemia, and MDS is patients with dysmyelopoietic syndrome. The numbers added to these abbreviations are healthy volunteer numbers and patient numbers. HV is healthy volunteers, AML is patients with acute myelocytic leukemia, and MDS is patients with dysmyelopoietic syndrome. The numbers added to these abbreviations are healthy volunteer numbers and patient numbers. Res indicates patients who responded to treatment; and nonRes indicates patients who did not respond to treatment. Further, pre indicates pre-treatment, and 4 w, 8 w, 12 w, and 42 w indicate 4 weeks, 8 weeks, 12 weeks, and 42 weeks, respectively, after the treatment. Phase 1 denotes the first phase of clinical trials. PB(pre) indicates peripheral blood before treatment; and BM(pre) indicates bone marrow before treatment.

BEST MODE FOR CARRYING OUT THE INVENTION

Figures 2, 3, 4, 5, 6, 7, 8, 9, 10, 11, 12, 13, 14, 15, 16, 17, 18, 19, 20:
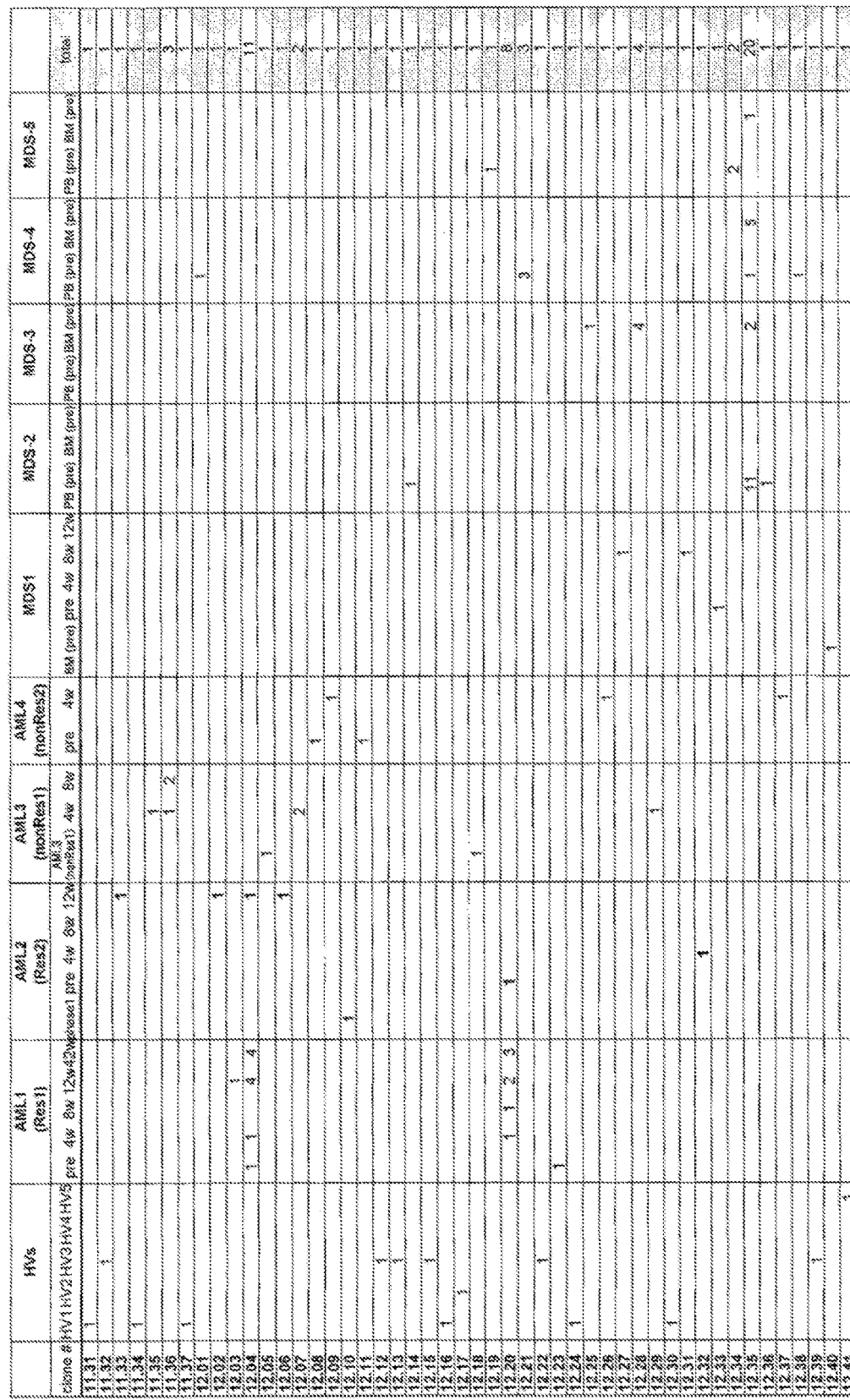

The present inventors stained the peripheral lymphocytes from cancer patients with WT1 tetramer that comprises WT1 peptide/HLA-A*2402 complexes, and separated WT1 tetramer-positive cells one by one using a FACS; cDNAs were generated from each separated cell, and the nucleotide sequences encoding CDR3 contained in the Vβ chain of T-cell receptors (hereinafter may be referred to as "TCR") of WT1-specific cytotoxic T-cells (CTLs, hereinafter may be referred to as "WT1-specific CTL") were determined by applying PCR method (FIGS. 1-1 to 1-62). From these results, the amino acid sequences of the CDR3 were also determined (FIGS. 1-1 to 1-62; SEQ ID Nos.: 1697-3392). These sequences have been determined for the first time in the present invention.

Thus, in a first aspect, the present invention provides a polynucleotide having the nucleotide sequence encoding CDR3 of the Vβ chain of T-cell receptors (TCRs) of WT1-specific cytotoxic T-cells (CTLs) obtained from healthy individuals and HLA-A*2402-positive patients, wherein the polynucleotide is DNA having any of the CDR3 nucleotide sequences shown in SEQ ID Nos.: 1-1696, RNA complementary to the DNA, or a polynucleotide having a complementary sequence thereof. As used herein, these DNA and RNA molecules and the complementary polynucleotides thereof are collectively referred to as "CDR3 polynucleotides." For example, the CDR3 polynucleotides include, in addition to the DNAs comprising the nucleotide sequences shown in SEQ ID Nos.: 1-1696, DNAs comprising these sequences. Also, for example, the CDR3 polynucleotides include, in addition to the RNAs complementary to the DNAs comprising the nucleotide sequences shown in SEQ ID Nos.: 1-1696, RNAs comprising these sequences. Further, for example, the CDR3 polynucleotides include polynucleotides having the sequences of the DNAs or RNAs, and polynucleotides complementary to the RNAs. The "CDR3 polynucleotides" include those having degenerate sequences encoding "CDR3 peptides."

In another aspect, the present invention provides peptides having the amino acid sequences of CDR3 of the Vβ chain of T-cell receptors (TCRs) of WT1-specific cytotoxic T-cells (CTLs), which CDR3 amino acid sequences being shown in any of SEQ ID Nos.: 1697-3392. As used herein, these peptides are collectively referred to as "CDR3 peptides." For example, the CDR3 peptides include, in addition to a peptide comprising any of the CDR3 amino acid sequences shown in SEQ ID Nos.: 1697-3392, peptides comprising these CDR3 amino acid sequences (such as, for example, Vβ chain peptides or a portion thereof). In addition, a peptide consisting or comprising the amino acid sequence shown in SEQ ID Nos.: 1697-3392 in which one or a few, preferably one to three, one or two, or one amino acid is substituted, added, or deleted is included in the "CDR3 peptides." However, these peptides are required to have equivalent functions to the original peptide. These CDR3 peptides are encoded by the above-mentioned CDR3 polynucleotides.

The CDR3 regions are the most diverse portions and are the most responsible parts for the specificity of antigen recognition. Thus, the sequences of the CDR3 polynucleotides and CDR3 peptides of the present invention are considered peculiar to WT1-specific CTL in HLA-A*2402-positive patients. Therefore, provided that the polynucleotide encoding the CDR3 region of the gene for the TCR Vβ chain of a certain T-cell or the peptide corresponding to the CDR3 region have the sequence of the polynucleotide or peptide of the present invention, the T-cell is considered as specific for WT1. Accordingly, the CDR3 polynucleotides and CDR3 peptides of the present invention may find use as markers for a wide variety of cancers, use in applications such as diagnosis of cancer, diagnosis of the susceptibility of patients to WT1 peptide immunotherapy, and tests for the responsiveness in the patients to WT1 peptide immunotherapy.

The CDR3 polynucleotides and CDR3 peptides of the present invention may be present in the lymphocytes of patients with any type of cancer as long as the cancer is generated from cells containing WT1. WT1 is known as a cancer antigen in a variety of cancers and hematological malignancies. Thus, the CDR3 polynucleotides and CDR3 peptides of the present invention, as well as the methods of the present invention described below, may be applied to almost all the types of cancers including, but not limited to, for example, hematologic malignancies, such as acute myelocytic leukemia, acute lymphocytic leukemia, malignant lymphoma, multiple myeloma, chronic myelocytic leukemia, myelodysplastic syndrome, and recurrence after the transplantation of hematopoietic stem cells of the same type; solid cancers, such as tongue cancer, gingival cancer, mouth floor cancer, pharyngeal cancer, larynx cancer, salivary gland cancer, and thyroid cancer; thoracic cancers, such as breast cancer, lung cancer, and thymic cancer; gastrointestinal cancers, such as colon cancer, small intestine cancer, gastric cancer, pancreatic cancer, liver cancer, bile duct cancer, gastrointestinal endocrine tumor, and gastrointestinal carcinoid; cancers of urinary and genital tract, such as renal cancer, urothelial cancer, germinoma, Wilms' tumor, prostate cancer, uterine body cancer, cervical cancer, uterine sarcoma, and ovarian malignancy; musculoskeletal malignancies, such as primary malignancy of bone (e.g., osteosarcoma and Ewing's sarcoma) and soft tissue sarcoma; and other cancers, such as skin cancer, neuroblastoma, malignant glioma (glioblastoma), primary malignant lymphoma of the central nervous system, medulloblastoma, and PNET.

When producing CDR3 polynucleotides or CDR3 peptides, conventional genetic engineering techniques and/or chemical synthetic procedures may be used. For example, CDR3 polynucleotides may be isolated from cells or chemically synthesized. CDR3 polynucleotides may also be amplified using a known method, such as PCR. Also, for example, a CDR3 polynucleotide (optionally amplified to an appropriate level using a known method) may be integrated into a suitable vector and introduced into suitable cells, or may be introduced into suitable cells by biolistic bombardment or electroporation. Then the cells into which the CDR3 polynucleotide is introduced are cultured for expression, thereby obtaining the CDR3 polynucleotide or peptide. Available vectors and cells, conditions for gene transfer, culture conditions, and methods for isolating genes and peptides are known to those skilled in the art and appropriately selected for use. Chemical synthesis may be used to produce CDR3 polynucleotides or CDR3 peptides. Methods for such chemical synthesis are known, and the methods for chemical synthesis of genes include solid-phase DNA synthesis using amidite, and the 1-4 phosphonate method; the methods for chemical synthesis of peptides include the Fmoc method.

Thus, in a further aspect, the present invention provides a method for diagnosing cancer in an HLA-A*2402-positive patient, the method including assessing the clonality of WT1-specific CTL having any of the CDR3 polynucleotides or CDR3 peptides in a sample obtained from the patient before therapy, wherein if a multiplicity of clonality are present, the patient is determined to have a possibility of cancer. As used herein, the term "clonality" refers to the frequency of detection of cells having an identical nucleotide or amino acid sequence. To examine clonality, it is general to use a cell sorter that allows identification of individual cells. The "patients" include both humans suspected to have cancer and those suffering from cancer.

The present inventors have found that it is possible to determine whether a patient develops cancer or not by examining the clonality of WT1-specific CTL having any of the CDR3 polynucleotides or CDR3 peptides in the patient. As can be seen from FIGS. 2-1 to 2-36, in the healthy individuals (HV1 to HV4), the clonality of WT1-specific CTL having any of the CDR3 polynucleotides or CDR3 peptides is 1 for almost all the clones, and 2 or 3 for rare clones; however, by contrast, all the cancer patients before therapy (AMLs (acute myelocytic leukemia) 1-4 and MDS (myelodysplastic syndrome) 1-5) have a multiplicity of clonality of the WT1-specific CTLs having any of the CDR3 polynucleotides or CDR3 peptides without exception. The number of the clonality is larger and the types of such cells are more abundant than those of the healthy individuals. The increases in clonality and in types of cells having a multiplicity of clonality in patients before therapy indicate a possibility that defense and attack against cancer cells has already been launched in the patients.

In view of these results, the possibility of cancer in a patient may be determined if a multiplicity of clonality is found in the WT1-specific CTL having any of the CDR3 polynucleotides or CDR3 peptides when examining a sample from a subject. Further, it is possible to determine that the larger the clonality of WT1-specific CTL having any of the CDR3 polynucleotides or CDR3 peptides, or the more abundant the types of WT1-specific CTLs having a multiplicity of clonality, the higher the possibility of developing cancer is in the subject before therapy. Also, in the determination method, it is possible to determine that the higher the possibility of developing cancer in the patient before therapy is when the clonality of WT1-specific CTL having any of the CDR3 polynucleotides or CDR3 peptides and having the clonality of 3 or more is larger, or the types of WT1-specific CTL having the clonality of 3 or more are more abundant.

In a further aspect, the present invention provides a method for testing for the sensitivity of an HLA-A*2402-positive patient to WT1 peptide immunotherapy, the method including assessing the clonality and the number of types of WT1-specific CTL clones having any of the polynucleotides of claim 1 or any of the peptides of claim in a sample obtained from the patient before therapy, wherein the patient is determined to have the sensitivity to WT1 peptide immunotherapy when the types of WT1-specific CTL clones with a multiplicity of clonality are more abundant in the patient than in non-responsive subjects.

WT1-specific CTLs having any of the CDR3 polynucleotides or CDR3 peptides act against cancer cells in the patients. In this process, the clones that already have a multiplicity of clonality before the therapy tend to further increase the clonality or maintain their clonality by WT1 peptide immunotherapy. It is also considered that WT1 immunotherapy is more likely to be successful when there are clones of as many types as possible, which gives increased number and types of effective WT1-specific CTL clones as a whole. More strictly speaking, the sensitivity of a patient to WT1 peptide immunotherapy may be determined as being high when the types of WT1-specific CTL clones with a multiplicity of clonality are more abundant in the patient than in non-responsive subjects.

As can be seen from FIGS. 2-1 to 2-36, the AML patients who responded to WT1 peptide immunotherapy had a larger number of the types of clones with a multiplicity of clonality than the healthy subjects and non-responsive patients before the therapy. AML1 (responder): 10 types (clonality of 58 in total); AML2 (responder): 12 types (clonality of 93 in total); AML3 (non-responder): 9 types (clonality of 27 in total); and AML4 (non-responder): 4 types (clonality of 15 in total). Healthy individuals HV1-5 had clones with a multiplicity of clonality in a range of 0 to 2 types.

In a further aspect, the present invention provides a method for monitoring WT1 peptide immunotherapy in an HLA-A*2402-positive patient, the method including assessing the clonality of WT1-specific CTL clones having any of the polynucleotides of claim 1 or any of the peptides of claim 2 in a sample obtained from the patient before and after the therapy, wherein the patient is determined to have responded to WT1 peptide immunotherapy when the clonality of any of the WT1-specific CTL clones increases after the therapy compared to before the therapy.

As can be seen from FIGS. 2-1 to 2-36, WT1-specific CTLs are observed in which the clonality increased (including the cases where the clonality increased from 0 to 1 or more) in the AML patients during the period of WT1 peptide immunotherapy. The exemplary clones exhibiting such behavior include Clones #02.28, #05.034, #05.135, #05.219, #09.65, #12.04, #13.13, #27.016, and #28.83 from AML (Pt1), and Clones #02.27, #05.035, #05.141, #05.219, #06.009, #12.04, #12.20, #15.44, #20.068, and #27.032 from AML (Pt2). The presence of clones that increases their clonality due to WT1 peptide immunotherapy indicates the responsiveness to the WT1 peptide immunotherapy. In other words, increases in the clonality suggests that the WT1 peptide immunotherapy showed its effect for a certain period of time. These increases in clonality may be transient or sustained. If the clonality of certain clones may increase only temporarily and then decrease, the clonality of other WT1-specific CTLs would increase to complement the effect. Considering the effect on cancer cells, a larger increase in the clonality is more desired. Therefore, the larger becomes the increase in the clonality or the more abundant become the types of clones with increased clonality after the WT1 peptide immunotherapy, the patient may be determined to have higher responsiveness to the WT1 peptide immunotherapy. The number and properties of cancer cells may be examined using an appropriate method depending on the type and site of the cancer.

In the method for monitoring therapy, although the clonality is compared before and after WT1 peptide immunotherapy, the time period between the before and after the therapy may be of any length. For example, it may be a few days, one week, two, three, or four weeks, or two or three months or more.

In the methods of the present invention described above, the means and methods for assessing clonality and determining the types of clones (i.e., determining the amino acid sequences of CDR3 peptides or the nucleotide sequences encoding the same) are known in the art, and those skilled in the art may conveniently carry out these operations. For example, as shown in Examples in the specification, a known sorting apparatus, such as the FACSAria system, and a method for gene amplification, such as PCR (using, for example, a primer set selected from the sequences listed in Table 1), may be used. In order to analyze the CDR3 polynucleotides or CDR peptides of the present invention in a stricter or more definite manner, one has only to confirm whether the nucleotide sequences of CDR3, IMGT, and the J and D regions in the Vβ chain gene are shown in FIGS. 1-1 to 1-62. Such confirmation is well within the ordinary skill of the art.

WT1 peptide immunotherapy is also known. For example, it may be performed on HLA-A*2402-positive patients by administering HLA-A*2402-restricted WT1 peptide in the native form (having the amino acid sequence: CMTWNQMNL) or in the modified form (having the amino acid sequence: CYTWNQMNL) via, for example, a transdermal route. In general, a single dose is in the order of µg/kg body weight to mg/kg body weight, and it may be administered at an interval of one week to a few weeks.

In a further aspect, the present invention provides a chip comprising the CDR3 polynucleotides or the polynucleotides complementary thereto; a chip comprising the CDR3 peptides; or a chip comprising antibodies against the CDR3 peptides. The chips may be in the form of microchips, microarrays, and the like. The production of the chips may be conducted according to conventional methods; for example, antibodies raised against the CDR3 polynucleotides or CDR3 peptides may be immobilized on a glass substrate. The species of the CDR3 polynucleotides or the polynucleotides complementary thereto, the CDR3 peptides, or the antibodies against the CDR3 peptides that is immobilized on the chip may be one to all; preferably, all the species are immobilized for exhaustive analysis. For example, all the polynucleotides comprising the nucleotide sequences complementary to the nucleotide sequences shown in SEQ ID Nos.: 1-1696 may be immobilized on the chip; alternatively, for example, antibodies that specifically recognize and bind to all the peptides comprising the amino acid sequences shown in SEQ ID Nos.: 1697-3392 may be immobilized on the chip. The CDR3 polynucleotides or the polynucleotides complementary thereto, the CDR3 peptides, or the antibodies against the CDR3 peptides may be placed at any position on the chip.

The chips may be used for, for example, diagnosis of cancer as described above. The samples may be affected tissues, body fluids such as blood and lymphatic fluid, or mucosal membranes. Preferably, the samples are peripheral blood. For example, when CDR3 polynucleotides are to be analyzed, the nucleic acids are extracted from the cells according to conventional methods, and a chip onto which all the species of polynucleotides comprising the nucleotide sequences complementary to the nucleotide sequences shown in SEQ ID Nos.: 1-1696 are immobilized may be used to examine the species and quantity of the hybridized DNA present in the sample. Also, for example, when CDR3 peptides are to be analyzed, a chip onto which antibodies that specifically recognize and bind to all the species of peptides comprising the amino acid sequences shown in SEQ ID Nos.: 1697-3392 are immobilized may be used to examine the species and quantity of the specifically bound peptides present in the sample.

In this regard, the present invention provides an antibody that specifically recognizes and binds to a CDR3 peptide. Preferably, such an antibody specifically recognizes and binds to any of the amino acid sequences shown in SEQ ID Nos.: 1697-3392. Methods for preparing such an antibody are known to those skilled in the art.

Typically, DNAs in the sample or DNA sequences placed on the chip are labeled so that the presence or absence, or the amount of hybridization is indicated. For example, the presence or absence, or the species of CDR3 peptides in a sample may be identified by arraying antibodies for each of the CDR3 peptides of SEQ ID Nos.: 1697-3392 on a chip and testing for their specific binding to the CDR3 peptides present in the sample. Typically, the peptides in the sample or the antibodies on the chip are labeled so that the presence or absence of the specific binding can be determined. Labels capable of indicating the presence or absence and the amount of hybridization or specific binding are known and include, for example, fluorescent labels, radioactive labels, enzyme labels, and chromophore labels. One skilled in the art may conveniently select suitable labels. The chips described above may be used to analyze a plurality of samples at the same time.

The CDR3 polynucleotides and CDR peptides of the present invention may be analyzed and identified using a known method, such as Southern blotting, Northern blotting, colony hybridization, and ELISA, as well as using the chips described above.

As described above, the CDR3 DNAs of the present invention have been identified using the primers shown in Examples, particularly, the primer sets shown in Table 1. Therefore, the present invention provides primers for amplifying CDR polynucleotides, which primers having the sequences selected from the sequences shown in SEQ ID Nos.: 3394-3421. For example, a primer set comprising the primers shown in SEQ ID Nos.: 3396-3420 may be used for amplification of a CDR3 polynucleotide.

The present invention also provides a kit for diagnosing cancer including means for detecting a WT1-specific CTL having a CDR3 polynucleotide or CDR3 peptide; a kit for testing for the sensitivity of a patient to WT1 peptide immunotherapy; or a kit for monitoring WT1 peptide immunotherapy. The present invention further provides a device for cancer diagnosis including means for detecting a WT1-specific CTL having a CDR3 polynucleotide or CDR3 peptide; a device for testing for the sensitivity of a cancer patient to WT1 peptide immunotherapy; or a device for monitoring WT1 peptide immunotherapy. A part for amplifying genes, such as a primer set, as described above, a chip as described above, or means for analyzing the information obtained from the chip may be used in the kit as a component or in the device.

In still another aspect, the present invention relates to a lymphocyte from an HLA-A*2402-positive cancer patient, which lymphocyte incorporating a T-cell receptor gene containing a sequence of a CDR3 polynucleotide. Preferably, such a lymphocyte is a peripheral blood lymphocyte into which the gene for the Vβ chain of TCR of WT1-specific CTLs comprising a CDR3 polynucleotide of the present invention, and a gene for the Vα chain of TCR of WT1-specific CTLs. In preparation of such a peripheral blood lymphocyte, a single species of the gene for the Vβ chain of TCR of WT1-specific CTLs may be used to obtain a plurality of types of peripheral blood lymphocytes, which are in turn introduced into patients. However, in view of improving the therapeutic effect, it is preferred to use a plurality of species of the gene for the Vβ chain of TCR of WT1-specific CTLs to obtain a plurality of types of peripheral blood lymphocytes, which are in turn introduced into patients. Alternatively, it is also preferred to select the nucleotide sequences of a suitable gene to be introduced depending on individual circumstances, because the therapeutically effective nucleotide sequences in the gene may differ depending on patients and cancer types.

Methods for preparing a gene to be introduced and for introducing the gene into peripheral blood lymphocytes are known in the art. For example, a gene to be introduced may be integrated into a suitable vector and then introduced into suitable cells, or may be introduced into suitable cells by biolistic bombardment or electroporation. Other conditions for gene transfer and for cell culture may be appropriately selected by those skilled in the art.

The lymphocytes into which a gene has been introduced as described above may be cultured ex vivo to obtain a large amount of WT1-specific CTLs. Then, the CTLs obtained may be introduced into a cancer patient to kill tumor cells expressing WT1, thereby performing cancer therapy. Patients preferred for introduction of the CTLs obtained are the patients from whom the peripheral blood lymphocytes were obtained.

The cancer therapy described above may be combined with other cancer therapies including anti-cancer agents and radiotherapy. The cancer therapy described above has a wide range of applications. They are exemplified above, but are not limited thereto.

In still another aspect, the present invention provides an antibody against a CDR3 peptide and a method of use thereof. Methods for preparing such an antibody are known in the art. Such an antibody may be used to detect or identify a lymphocyte having the amino acid sequence of the CDR3 peptide of the present invention or an amino acid sequence containing the above sequence in its Vβ chain in the subject sample. For example, antibodies against peptides comprising the amino acid sequences of any of SEQ ID Nos.: 1697-3392 may be used to detect or identify cancer-specific lymphocytes. These antibodies may also be used to carry out the methods of the present invention, for example, the method for diagnosing cancer.

Such an antibody may also be contacted with lymphocytes having the amino acid sequence of CDR3 of the present invention to activate them. The lymphocytes thus activated may be used to treat cancer. Preferably, lymphocytes obtained from a cancer patient are activated and, if necessary, proliferated, and the cancer therapy is conducted by returning the lymphocytes to the patient. Such an antibody may also be used to enrich the WT1-specific T-cells of interest. For example, such an antibody may be used to enrich the WT1-specific T-cells in a cancer patient, thereby assisting the cancer therapy.

In a further aspect, the present invention provides a method for identifying the position and size of a solid cancer, the method including: administering the peripheral blood lymphocytes of the present invention described above after being labeled with a detectable label, and then examining the location and quantity of the label. The label may be a known label, such as radioactive label, e.g. Tecnecium-99, and fluorescent label. Methods for labeling cells are also known. Detection of labels and quantification of signals are also known in the art; they can be performed using a radiation counter, by fluorescence assay, or by obtaining a tissue sample by biopsy.

The present invention is illustrated in greater detail below with reference to Examples, but it should be understood that the present invention is not construed as being limited thereto.

EXAMPLE 1

A. Experimental Methods and Materials Used (1) Cells

Peripheral blood samples were obtained from five healthy volunteers (HV1 to HV5) and four HLA-A*2402-positive AML patients (AML1 to AML4). Bone marrow samples and peripheral blood samples were obtained from five HLA-A*2402-positive MDS patients (MDS1 to MDS5). More specifically, peripheral blood was obtained before treatment and at weeks 4, 8, 12, and 42 of treatment from ALM1. Peripheral blood was obtained before treatment and at weeks 4, 8, 12, and 42 of treatment from ALM2. Peripheral blood was obtained before treatment and at weeks 4 and 8 of treatment from ALM3. Peripheral blood was obtained before treatment and at week 4 of treatment from ALM4. From MDS1, bone marrow and peripheral blood were obtained before treatment; and peripheral blood was obtained at weeks 4, 8, and 12 of treatment. Peripheral blood and bone marrow before treatment were collected from MDS1 to MDS5. The peripheral blood samples obtained were subjected to Ficoll-Hypaque (Pharmacia, Uppsala, Sweden) density gradient centrifugation and peripheral blood mononuclear cells (PBMCs) were separated and stored frozen at $-170°$ C. until use. The treatment on the patients was conducted using WT1 peptide immunotherapy. The amino acid sequence of the WT1 peptide used in the treatment is Cys-Tyr-Thr-Trp-Asn-Gln-Met-Asn-Leu (SEQ ID No.: 3393). This peptide was administered by intradermal injection at an interval of two weeks.

(2) Flow Cytometric Analysis and Sorting

Initially, $2×10^6$ PBMCs per sample were stained with PE-conjugated HLA-A*2402-WT1 235-243 tetramers (MBL, Tokyo, Japan) in FACS buffer (PBS containing 2% fetal bovine serum) for 30 minutes at 37° C. Subsequently, they were stained with monoclonal antibodies labeled with five different fluorescent dyes as described below for 25 minutes on ice in dark: FITC-labeled anti-CD4, CD14, CD16, CD19, and CD56, anti-CD3-PerCP, anti-CD8-APC-Cy7 (BD Bioscience, San Jose, Calif.), anti-CD45RA-APC, and anti-CCR7-PE-Cy7 (BD Pharmingen, San Diego, Calif.). The stained cells were washed twice in FACS buffer. Sorting was performed using the FACSAria system (BD Biosciences) and data analysis was performed using the FACSDiva software (BD Biosciences). As a result, single HLA-A*2402-WT1 235-243 tetramer$^+$CD3$^+$CD8$^+$ cells were obtained from the fraction of CD4⁻CD14⁻CD16⁻CD19⁻CD56⁻ cells and were defined as WT1-Tet⁺ cells.

(3) cDNA Synthesis of the TCR-β Chain from the Single Cells Sorted

To eliminate DNA contamination for RT-PCR of sufficient single cells, cDNA synthesis was carried out, and all the steps of PCR were performed in a different clean bench. Single WT1-Tet⁺ cells were sorted directly in a PCR tube containing 15 μl of a cDNA reaction mixture. The cDNA reaction mixture contained the following components in lysis buffer (1×cDNA buffer containing 0.5% Triton X-100): reverse transcriptase (SuperScript III, Invitrogen, Carlsbad, Calif.), 0.5 mM dNTPs (Invitrogen), 20 units (U) of Rnase inhibitor (Invitrogen), 100 μg/ml gelatin (Roche, Indianapolis, Ind.), 100 μg/ml tRNA (Roche), and a 200 nM primer (5'-CACCAGTGTGGCCTTTTG-3' (SEQ ID No.: 3394)) specific for the TCR-β chain constant region. After the sorting, the samples were incubated for 90 minutes at 50° C. for cDNA synthesis, and then incubated for 5 minutes at 95° C. for terminating the reaction.

(4) Semi-Nested Multiplex-PCR

Ten μl of a synthesized cDNA product obtained by the above procedure was added to 40 μl of a reaction mixture. The reaction mixture contained 1×PCR buffer, 2 mM MgCl₂, 0.25 mM dNTPs, 1.25 U DNA polymerase (Platinum Taq DNA Polymerase, Invitrogen), a 5 nM mixture of 24 different Vβ-family-specific forward primers (shown in Table 1), and 5 nM 3'-Cβ reverse primer (5'-GCTTCT-GATGGCTCAAACACAGC-3' (SEQ ID No.: 3395)). The procedure of PCR was as follows: a pre-PCR heating step at 95° C. for 2 minutes, followed by 40 cycles of a denaturing step at 95° C. for 45 seconds, an annealing step at 57° C. for 45 seconds, and an extension step at 72° C. for 50 seconds.

TABLE 1

| S2 | TRBV2 | GGTCACACAGATGGGACAGGAAGT | (SEQ ID No. 3396) |
|---|---|---|---|
| S2 | TRBV3 | CCCAGACTCCAAAATACCTGGTCA | (SEQ ID No. 3397) |
| S5 | TRBV4 | TACGCAGACACCAA<GA>ACACCTGGTCA | (SEQ ID No. 3398) |
| S1 | TRBV5 | ACAGCAAGTGAC<TAG>CTGAGATGCTC | (SEQ ID No. 3399) |
| S7 | TRBV6 | GTGTCACTCAGACCCCAAAATTCC | (SEQ ID No. 3400) |
| S4 | TRBV7-1 | GTGTGATCCAATTTCAGGTCATAC | (SEQ ID No. 3401) |
| S3 | TRBV7-3 | ATGTAACT<CT>TCAGGTGTGATCCAA | (SEQ ID No. 3402) |
| S1 | TRBV9 | ACAGCAAGTGAC<TAG>CTGAGATGCTC | (SEQ ID No. 3403) |
| S1 | TRBV10 | CCAAGACACAAGGTCACAGAGACA | (SEQ ID No. 3404) |
| S4 | TRBV11 | CAGTCTCCCAGATATAAGATTATAGAG | (SEQ ID No. 3405) |
| S4 | TRBV12 | GGTGACAGAGATGGGACAAGAAGT | (SEQ ID No. 3406) |
| S8 | TRBV13 | CTGATCAAAGAAAAGAGGGAAACAGCC | (SEQ ID No. 3407) |
| S6 | TRBV14 | ATAGAAGCTGGAGTTACTCAGTTC | (SEQ ID No. 3408) |
| S8 | TRBV15 | CAAGATACCAGGTTACCCAGTTTG | (SEQ ID No. 3409) |
| S5 | TRBV18 | TGCAGAACCCAAGACACCTGGTCA | (SEQ ID No. 3410) |
| S5 | TRBV19 | CACTCAGTCCCCAAAGTACCTGTT | (SEQ ID No. 3411) |
| S2 | TRBV20 | GAGTGCCGTTCCCTGGACTTTCAG | (SEQ ID No. 3412) |
| S6 | TRBV21 | AAGGTCACCCAGAGACCTAGACTT | (SEQ ID No. 3413) |
| S6 | TRBV23 | ACAAAGATGGATTGTACCCCCGAA | (SEQ ID No. 3414) |
| S7 | TRBV24 | GTTACCCAGACCCCAAGGAATAGG | (SEQ ID No. 3415) |
| 51 | TRBV25 | GATCACTCTGGAATGTTCTCAAACC | (SEQ ID No. 3416) |
| S3 | TRBV27 | GTGACCCAGAACCCAAGATACCTC | (SEQ ID No. 3417) |
| S2 | TRBV28 | GTAACCCAGAGCTCGAGATATCTA | (SEQ ID No. 3418) |
| S3 | TRBV29 | TCCAGTGTCAAGTCCATAGCCAAGTC | (SEQ ID No. 3419) |
| S5 | TRBV30 | GTCAGATCTCAGACTATTCATCAATGG | (SEQ ID No. 3420) |

Next, the PCR products were subjected to screening PCR. One μl of each PCR product was placed in separate 8 tubes and 24 μl of a reaction mixture was added to each of the tubes. The reaction mixture contained 1×PCR buffer, 2 mM MgCl₂, 0.2 mM dNTPs, 1.0 U of Platinum Taq DNA polymerase, one set of forward primers selected from the 8 screening sets S1 to S8, shown in Table 1, and 5'-Cβ reverse primer (5'-GGAACACGTTTTTCAGGTCCT-3' (SEQ ID No.: 3421)) (150 nM each). The procedure of PCR was as follows: a pre-PCR heating step at 95° C. for 2 minutes, followed by 35 cycles of a denaturing step at 94° C. for 45 seconds, an annealing step at 57° C. for 45 seconds, and an extension step at 72° C. for 40 seconds.

To verify positive reactions in the 8 screening PCRs, 5 µl of each screening PCR product was subjected to 2% agarose gel electrophoresis, followed by further PCR. This PCR was performed 35 cycles using 150 nM each of the Vβ-specific forward primers contained in the screening sets that were confirmed as positive. The positive reaction was verified by 2% agarose gel electrophoresis. A cell-free system was used as negative contrast, and three wells were prepared for the negative contrast in the same manner as above. The experiment was performed according to the same procedure.

(5) Determination and Analysis of the Sequences of the Complementarity-Determining Region 3 (CDR3) of TCR-β

Amplified fragments of the TCR-β gene were purified using the PCR Purification Kit (Qiagen, Valencia, Calif.). Corresponding TCR Vβ-specific forward primers were used for sequencing. The ABI PRIAM BigDye Terminator v 3.1 Cycle Sequencing kit (Applied Biosystems, Foster City, Calif., USA) was used for sequencing, and the ABI PRISM 3100 Genetic Analyzer (Applied Biosystems) was used for analysis. The sequence data on CDR3 were analyzed by comparing the sequences with those available from the website of the IMGT human TCR gene database (imgt.cines.fr).

B. Results

The sequences of the gene for the Vβ chain, the J region sequences, D region sequences, N region sequences, CDR3 nucleotide sequences, and CDR3 amino acid sequences of WT1-specific CTLs derived from healthy individuals and cancer patients (AML1 to AML4 and MDS1 to MDS5) are shown in FIGS. 1-1 to 1-62. The clonality of each WT1-specific CTL is shown in FIGS. 2-1 to 2-36. The CDR3 nucleotide sequences are shown in SEQ ID Nos.: 1-1696 (since clones #24.29 and #28.92 have the identical CDR3 nucleotide sequence, only clone #24.29 is shown in the Sequence Listing), and the CDR3 amino acid sequences are shown in SEQ ID Nos.: 1697-3392 (since clones #2.53 and #28.58 have the identical CDR3 amino acid sequence, and so do clones #24.29 and #28.92, only clones #2.53 and #24.19 are shown in the Sequence Listing). Among the AML patients, AML1 and AML2 responded to the treatment, but AML3 and AML4 did not. The response of the MDS patients to the treatment has not been determined.

As can be seen from FIGS. 2-1 to 2-36, in the healthy individuals (HV1 to HV4), the clonality of WT1-specific CTL having any of the CDR3 polynucleotides or CDR3 peptides is 1 for almost all the clones, and 2 or 3 for rare clones; however, all the cancer patients before therapy (AMLs and MDSs) have a multiplicity of clonality of the WT1-specific CTLs having any of the CDR3 polynucleotides or CDR3 peptides without exception. The number of the clonality was larger and the types of such cells were more abundant in the cancer patients than in the healthy individuals.

The increases in clonality and in types of cells having a multiplicity of clonality in patients before therapy indicate a possibility that defense and attack against cancer cells has already been launched in the patients and suggest that cancer cell are already present in the patients.

Also, as can be seen from FIGS. 2-1 to 2-36, the AML patients who responded to WT1 peptide immunotherapy had a larger number of types of clones with a multiplicity of clonality than the healthy subjects and non-responsive patients before the therapy. AML1 (responder): 10 types (clonality of 58 in total); AML2 (responder): 12 types (clonality of 93 in total); AML3 (non-responder): 9 types (clonality of 27 in total); and AML4 (non-responder): 4 types (clonality of 15 in total. Healthy individuals HV1-5 had clones with a multiplicity of clonality in a range of 0 to 2 types.

The clones that already have a multiplicity of clonality before the therapy tend to further increase the clonality or maintain their clonality by WT1 peptide immunotherapy. It is also considered that WT1 peptide immunotherapy is more likely to be successful when there are clones of as many types as possible, which gives increased number and types of effective WT1-specific CTL clones as a whole.

As can be seen from FIGS. 2-1 to 2-36, WT1-specific CTLs were observed in which the clonality increased either temporarily or continuously (including the cases where the clonality increased from 0 to 1 or more) in the AML patients during the period of WT1 peptide immunotherapy. The exemplary clones exhibiting such behavior include clones #02.28, #05.034, #05.135, #05.219, #09.65, #12.04, #13.13, #27.016, and #28.83 from AML (patient 1—a responder), and clones #02.27, #05.035, #05.141, #05.219, #06.009, #12.04, #12.20, #15.44, #20.068, and #27.032 from AML (patient 1—a non-responder). For example, from the change in the clonality of clone #02.28 from AML patient 1, it is found that the therapeutic effect was high at the onset of the treatment and at week 4.

An increase in the clonality of a certain clone indicates that the WT1 peptide immunotherapy showed its effect for a certain period of time. Even if the clonality of certain clones may increase temporarily and then decrease, the clonality of other WT1-specific CTLs would increase to complement the effect. Considering the effect on cancer cells, a larger increase in the clonality is more desired. Therefore, the larger becomes the increase in the clonality or the more abundant become the types of clones with increased clonality after the WT1 peptide immunotherapy, the responsiveness to the WT1 peptide immunotherapy is considered to have been high.

INDUSTRIAL APPLICABILITY

The present invention may provide pharmaceutical compositions useful for anti-cancer therapy, cancer test kits or reagents, reagents for cancer research, and the like. Therefore, the present invention may find use in the fields of pharmaceuticals for cancer therapy, of cancer test kits or reagents, and of cancer research.

SEQUENCE LISTING (3421 sequences)

SEQ ID NO: 1 - DNA, 42 bp, Homo sapiens
tgtgccggggcaccccgaataaacaccggggagctgtttttt

SEQ ID NO: 2 - DNA, 36 bp, Homo sapiens
tgtgccgggttcgcgcccaacgagccccagcatttt

SEQ ID NO: 3 - DNA, 33 bp, Homo sapiens
tgtgccaaacagcggaacactgaagctttcttt

SEQ ID NO: 4 - DNA, 39 bp, Homo sapiens
tgtgccctagaggaggggggctacaatgagcagttcttc

SEQ ID NO: 5 - DNA, 42 bp, Homo sapiens
tgtgccaacagtgaagcgcctatcgactacgaccagtacttc

SEQ ID NO: 6 - DNA, 42 bp, Homo sapiens
tgtgccaacagtgaagcgcctatcgactacgagcagtacttc

SEQ ID NO: 7 - DNA, 48 bp, Homo sapiens
tgtgccaacagtatcgactggcggaagggaccagatacgcagtatttt

SEQ ID NO: 8 - DNA, 39 bp, Homo sapiens
tgtgccaacgtgttccacgaggggcatggctacaccttc

SEQ ID NO: 9 - DNA, 33 bp, Homo sapiens
tgtgccagggacattacagatacgcagtatttt

SEQ ID NO: 10 - DNA, 36 bp, Homo sapiens
tgtgccagcgacccggggatctatggctacaccttc

SEQ ID NO: 11 - DNA, 42 bp, Homo sapiens
tgtgccagcgatagcgggagaagcacagatacgcagtatttt

SEQ ID NO: 12 - DNA, 48 bp, Homo sapiens
tgtgccagcggggggctgactagcgggagccgggatacgcagtatttt

SEQ ID NO: 13 - DNA, 39 bp, Homo sapiens
tgtgccagcggcatacaggggcgcaatgagcagttcttc

SEQ ID NO: 14 - DNA, 51 bp, Homo sapiens
tgtgccagcaaggtgacagaatgggtacaagccaaaaacattcagtacttc

SEQ ID NO: 15 - DNA, 39 bp, Homo sapiens
tgtgccagcctggggagggggcggcagccccagcatttt

SEQ ID NO: 16 - DNA, 45 bp, Homo sapiens
tgtgccagcaatgatgtggtttatagcaatcatccccttgatttt

SEQ ID NO: 17 - DNA, 42 bp, Homo sapiens
tgtgccagcaatgaagcccctagcgactacgagcagtacttc

SEQ ID NO: 18 - DNA, 42 bp, Homo sapiens
tgtgccagcaacgaatccactagcgactacgagcagtacttc

SEQ ID NO: 19 - DNA, 45 bp, Homo sapiens
tgtgccagcaacaggccggacagcacgtactacgagcagtacttc

SEQ ID NO: 20 - DNA, 41 bp, Homo sapiens
tgtgccagcagggacgggacttactacaccggggagctgtt

SEQ ID NO: 21 - DNA, 39 bp, Homo sapiens
tgtgccagcagggacaggggtgccggggagctgtttttt

SEQ ID NO: 22 - DNA, 36 bp, Homo sapiens
tgtgccagcaggggcggaccctacgagcagtacttc

SEQ ID NO: 23 - DNA, 51 bp, Homo sapiens
tgtgccagcagggtgacagaatgggtactagccaaaaacattcagtacttc

SEQ ID NO: 24 - DNA, 48 bp, Homo sapiens
tgtgccagcagtgcacggactaccggggatcaagaaacccagtacttc

SEQ ID NO: 25 - DNA, 51 bp, Homo sapiens
tgtgccagcagtgatggaaaggatacgttcatgaacactgaagctttcttt

SEQ ID NO: 26 - DNA, 45 bp, Homo sapiens
tgtgccagcagtgatccgcacagggacagcactgaagctttcttt

SEQ ID NO: 27 - DNA, 45 bp, Homo sapiens
tgtgccagcagtgatgtgggttatagcaatcagccccagcatttt

SEQ ID NO: 28 - DNA, 42 bp, Homo sapiens
tgtgccagcagtgaagcgcctagcgactacgagcagtacttc

SEQ ID NO: 29 - DNA, 42 bp, Homo sapiens
tgtgccagcagtgaagcgcctagcaactacgagcagtacttc

SEQ ID NO: 30 - DNA, 45 bp, Homo sapiens
tgtgccagcagtgaagcgcagcgggaaggagatacgcagtatttt

SEQ ID NO: 31 - DNA, 42 bp, Homo sapiens
tgtgccagcagtgaagcgactagcgactacgagcagtacttc

SEQ ID NO: 32 - DNA, 42 bp, Homo sapiens
tgtgccagcagtgaggacggcagctcagggccccagcatttt

SEQ ID NO: 33 - DNA, 45 bp, Homo sapiens
tgtgccagcagtgaagggggcgggggcgcggagacccagtacttc

SEQ ID NO: 34 - DNA, 45 bp, Homo sapiens
tgtgccagcagcgaaggtggagggggccaagagacccagtacttc

SEQ ID NO: 35 - DNA, 45 bp, Homo sapiens
tgtgccagcagtgagggactagcgattacagatacgcagtatttt

SEQ ID NO: 36 - DNA, 48 bp, Homo sapiens
tgtgccagcagtgaagggtctagcgggttttcctacgagcagtacttc

SEQ ID NO: 37 - DNA, 45 bp, Homo sapiens
tgtgccagcagtgaaggaactagcggatcctacgagcagtacttc

SEQ ID NO: 38 - DNA, 48 bp, Homo sapiens
  modified_base (27)..(27): a, c, t or g
tgtgccagcagtgaaaacggagcgggnacatccgatgagcagttcttc

SEQ ID NO: 39 - DNA, 45 bp, Homo sapiens
tgtgccagcagtgaatcaggaacgataatggagacccagtacttc

SEQ ID NO: 40 - DNA, 45 bp, Homo sapiens
tgtgccagcagtgaaacaggctctagcacagatacgcagtatttt

SEQ ID NO: 41 - DNA, 39 bp, Homo sapiens
tgtgccagcagtgaaacgggaacctacgagcagtacttc

SEQ ID NO: 42 - DNA, 45 bp, Homo sapiens
tgtgccagcagtggagaggcgggagggggggagacccagtacttc

SEQ ID NO: 43 - DNA, 45 bp, Homo sapiens
tgtgccagcagtggaggggcgggagggggggaaacccagtacttc

SEQ ID NO: 44 - DNA, 36 bp, Homo sapiens
tgtgccagcagcggggggaacgagccccatgatttt

SEQ ID NO: 45 - DNA, 36 bp, Homo sapiens
tgtgccagcagtggggggaacgagccccagcatttt

SEQ ID NO: 46 - DNA, 36 bp, Homo sapiens
tgtgccagcagtggggggaaccagccccatgatttt

SEQ ID NO: 47 - DNA, 36 bp, Homo sapiens
tgtgccagcagtggggggaatcagtcccatgatttt

SEQ ID NO: 48 - DNA, 51 bp, Homo sapiens
tgtgccagcagcgggaccttactagcgggagctagggatgagcagttcttc

SEQ ID NO: 49 - DNA, 51 bp, Homo sapiens
tgtgccagcagcgggaccttactatcccaagctagggatgagcagttcttc

SEQ ID NO: 50 - DNA, 51 bp, Homo sapiens
tgtgccagcagtgggactagcgggaggcccctatcctacgagcagtacttc

SEQ ID NO: 51 - DNA, 45 bp, Homo sapiens
tgtgccagcagtttattctgggctccccccgacgagcagtacttc

SEQ ID NO: 52 - DNA, 33 bp, Homo sapiens
tgtgccagcagcctcacagatacccactatttt

SEQ ID NO: 53 - DNA, 33 bp, Homo sapiens
tgtgccagcagcctcacagatacgcagtatttt

SEQ ID NO: 54 - DNA, 45 bp, Homo sapiens
tgtgccagcagtctggttaacgggagagctgacgagcagtacttc

SEQ ID NO: 55 - DNA, 39 bp, Homo sapiens
tgtgccagcagtatgacaaggagcactgaagctttcttt

SEQ ID NO: 56 - DNA, 42 bp, Homo sapiens
tgtgccagcagtaacgggggagggaacactgaagctttcttt

SEQ ID NO: 57 - DNA, 45 bp, Homo sapiens
tgtgccagcagtccggaaagcctccgcacagatacgcagtatttt

SEQ ID NO: 58 - DNA, 42 bp, Homo sapiens
tgtgccagcagtcagggactggaagcggacgagcagtacttc

SEQ ID NO: 59 - DNA, 45 bp, Homo sapiens
tgtgccagcagttccgggactagcccctacaatgagcagttcttc

SEQ ID NO: 60 - DNA, 39 bp, Homo sapiens
tgtgccagcagttccccagggtcctacgagcagtacttc

SEQ ID NO: 61 - DNA, 39 bp, Homo sapiens
tgtgccagcagttcaagtggagcagatacgcagtatttt

SEQ ID NO: 62 - DNA, 45 bp, Homo sapiens
tgtgccagcagcactctagcgggtagcacagatacgcagtatttt

SEQ ID NO: 63 - DNA, 36 bp, Homo sapiens
tgtgccagcagtgtacagggccttgaagctttcttt

SEQ ID NO: 64 - DNA, 42 bp, Homo sapiens
tgtgccagcactgaagcgcctaacgactacgagcagtacttc

SEQ ID NO: 65 - DNA, 42 bp, Homo sapiens
tgtgccagcacgttcgagggagatacagatacgcagtatttt

SEQ ID NO: 66 - DNA, 42 bp, Homo sapiens
tgtgccagcgggcacctccgttcctacaatgagcagttcttc

SEQ ID NO: 67 - DNA, 48 bp, Homo sapiens
tgtgccagccattatagagctagcgtgaacaccggggagctgtttttt

SEQ ID NO: 68 - DNA, 36 bp, Homo sapiens
tgtgccagcagcgagggtctctatggctacaccttc

SEQ ID NO: 69 - DNA, 48 bp, Homo sapiens
tgtgccagcagccacctagcggcgagctcctacaatgagcagttcttc

SEQ ID NO: 70 - DNA, 51 bp, Homo sapiens
tgtgccagcagccatagtatggggggagggggctacaatgagcagttcttc

SEQ ID NO: 71 - DNA, 48 bp, Homo sapiens
tgtgccagcagccacactagcgggagggccggtaatgagcagttcttc

SEQ ID NO: 72 - DNA, 48 bp, Homo sapiens
tgtgccagcagccttcgatcgggtggaggtggggatacgcagtatttt

SEQ ID NO: 73 - DNA, 48 bp, Homo sapiens
tgtgccagcagcctctcagggaaccggtctattcagaccccttctttt

SEQ ID NO: 74 - DNA, 45 bp, Homo sapiens
tgtgccagcagcctatctagcgggaggacttacgagcagtacttc

SEQ ID NO: 75 - DNA, 39 bp, Homo sapiens
tgtgccagcagccccgccgggactagggagcagttcttc

SEQ ID NO: 76 - DNA, 45 bp, Homo sapiens
tgtgccagcagcccattagcgggattcacagatacgcagtatttt

SEQ ID NO: 77 - DNA, 48 bp, Homo sapiens
tgtgccagcagccccccgacgggggatttttattcacccctccacttt

SEQ ID NO: 78 - DNA, 45 bp, Homo sapiens
tgtgccagcagcccacgggcgggagctggtggtgagcagttcttc

SEQ ID NO: 79 - DNA, 42 bp, Homo sapiens
tgtgccagcagcccacgccccggaggggaaaaactgtttttt

SEQ ID NO: 80 - DNA, 45 bp, Homo sapiens
tgtgccagcagccccagcgggaccttagaggctacgcagtatttt

SEQ ID NO: 81 - DNA, 45 bp, Homo sapiens
tgtgccagcagccccagcaggggggcctacaatgagcagttcttc

SEQ ID NO: 82 - DNA, 45 bp, Homo sapiens
tgtgccagcagcccttggacaggttcgtcctacgagcagtacttc

SEQ ID NO: 83 - DNA, 48 bp, Homo sapiens
tgtgccagcagccaggcacagggctcactctcctacgagcagtacttc

SEQ ID NO: 84 - DNA, 42 bp, Homo sapiens
tgtgccagcagccaagacgcgacagggaatggctacaccttc

SEQ ID NO: 85 - DNA, 51 bp, Homo sapiens
tgtgccagcagccaagaccggacaggggttgggaatcagccccagcatttt

SEQ ID NO: 86 - DNA, 42 bp, Homo sapiens
tgtgccagcagccaagatagcgggccctacgagcagtacttc

SEQ ID NO: 87 - DNA, 42 bp, Homo sapiens
tgtgccagcagccaagattcaccatcttatggctacaccttc

SEQ ID NO: 88 - DNA, 51 bp, Homo sapiens
tgtgccagcagccaagaaggtccttacagctcctacaatgagcagttcttc

SEQ ID NO: 89 - DNA, 36 bp, Homo sapiens
tgtgccagcagccaggggatggatggctacgccttc

SEQ ID NO: 90 - DNA, 45 bp, Homo sapiens
tgtgccagcagccaaccgggacagcgaaggggtggctacaccttc

SEQ ID NO: 91 - DNA, 48 bp, Homo sapiens
tgtgccagcagccaaccgactagcgggagtatttatgagcagttcttc

SEQ ID NO: 92 - DNA, 45 bp, Homo sapiens
tgtgccagcagccaacaattgcgggagggcgacgagcagtacttc

SEQ ID NO: 93 - DNA, 48 bp, Homo sapiens
tgtgccagcagccaaagagtaggactagcaaccaatgagcagttcttc

SEQ ID NO: 94 - DNA, 45 bp, Homo sapiens
tgtgccagcagccagtcgggcgggaaaacctacgagcagtacttc

SEQ ID NO: 95 - DNA, 54 bp, Homo sapiens
tgtgccagcagccaagtcattggggatctctctggggccaacgtcctgactttc

SEQ ID NO: 96 - DNA, 57 bp, Homo sapiens
tgtgccagcagccggggattgactagggaaggcctctcctacaatgagcagttcttc

SEQ ID NO: 97 - DNA, 51 bp, Homo sapiens
tgtgccagcagccgacctgcgggtgcccttggggccaacgtcctgactttc

SEQ ID NO: 98 - DNA, 42 bp, Homo sapiens
tgtgccagcagccgaagacagcagaatgaaaaactgtttttt

SEQ ID NO: 99 - DNA, 54 bp, Homo sapiens
tgtgccagcagctcccaatggaccgaggaaccgaagggctatggctacaccttc

SEQ ID NO: 100 - DNA, 42 bp, Homo sapiens
tgtgccagcaccccctcgacggagaacactgaagctttcttt

SEQ ID NO: 101 - DNA, 45 bp, Homo sapiens
tgtgccggcagccaaggattgggccgtggaaacaccatatatttt

SEQ ID NO: 102 - DNA, 36 bp, Homo sapiens
tgcgccagcagacagggccccaatgagcagttcttc

SEQ ID NO: 103 - DNA, 45 bp, Homo sapiens
tgcgccagcagaacgggacaggggtccaccggggagctgtttttt

SEQ ID NO: 104 - DNA, 30 bp, Homo sapiens
tgcgccagcagcgatgggtcgcagtatttt

SEQ ID NO: 105 - DNA, 39 bp, Homo sapiens
tgtgccagcagccatccccaggccggggagctgtttttt

SEQ ID NO: 106 - DNA, 51 bp, Homo sapiens
tgcgccagcagccacccgaggttagcgggagacgacaatgagcagttcttc

SEQ ID NO: 107 - DNA, 48 bp, Homo sapiens
tgcgccagcagccatccgaggacagaccaccaagagacccagtacttc

SEQ ID NO: 108 - DNA, 48 bp, Homo sapiens
tgcgccagcagccatccatcagcggggtcggccggcgagcagtacttc

SEQ ID NO: 109 - DNA, 45 bp, Homo sapiens
tgcgccagcagccataggagacaagttaattcacccctccacttt

SEQ ID NO: 110 - DNA, 51 bp, Homo sapiens
tgcgccagcagcaaaggggagggacggatttctggaaacaccatatatttt

SEQ ID NO: 111 - DNA, 45 bp, Homo sapiens
tgcgccagcagcctggacagaacgaacaccggggagctgtttttt

SEQ ID NO: 112 - DNA, 36 bp, Homo sapiens
tgtgccagcagcctcggcgacgaggagcagttcttc

SEQ ID NO: 113 - DNA, 42 bp, Homo sapiens
tgcgccagcagcctaggattgacgaacaatgagcagttcttc

SEQ ID NO: 114 - DNA, 48 bp, Homo sapiens
tgcgccagcagcctcagactagcgggagatgcggagacccagtacttc

SEQ ID NO: 115 - DNA, 48 bp, Homo sapiens
tgcgccagcagcttgactgttgcgggagggatgaacgagcagtacttc

SEQ ID NO: 116 - DNA, 45 bp, Homo sapiens
tgtgccagcagcctagtggcgaaatcctacaatgagcagttcttc

SEQ ID NO: 117 - DNA, 48 bp, Homo sapiens
tgtgccagcagccttgtccaatacagtccgaacactgaagctttcttt

SEQ ID NO: 118 - DNA, 48 bp, Homo sapiens
tgcgccagcagcaacggacagggacggaataattcacccctccacttt

SEQ ID NO: 119 - DNA, 48 bp, Homo sapiens
tgcgccagcagcccagctgggaccctgaacaccggggagctgtttttt

SEQ ID NO: 120 - DNA, 42 bp, Homo sapiens
tgcgccagcagcccagggggcagcaactatggctacaccttc

SEQ ID NO: 121 - DNA, 45 bp, Homo sapiens
tgcgccagcagcccgggacagcatagcaatcagccccagcatttt

SEQ ID NO: 122 - DNA, 48 bp, Homo sapiens
tgtgccagcagccccttggatagcggagccgggacggatcaatacttc

SEQ ID NO: 123 - DNA, 48 bp, Homo sapiens
tgtgccagcagccccttggatagcggagccgggacggagcagtacttc

SEQ ID NO: 124 - DNA, 45 bp, Homo sapiens
tgcgccagcagcccacttagggtagggccctacgagcagtacttc

SEQ ID NO: 125 - DNA, 36 bp, Homo sapiens
tgcgccagcagccccccggagggtacgcagtatttt

SEQ ID NO: 126 - DNA, 45 bp, Homo sapiens
tgcgccagcagcccgaggagttcgaacaccggggagctgtttttt

SEQ ID NO: 127 - DNA, 45 bp, Homo sapiens
tgcgccagcagcccacgtacggagactaactatggctacaccttc

SEQ ID NO: 128 - DNA, 45 bp, Homo sapiens
tgtgccagcagccccaggactagcggagaagagacccagtacttc

SEQ ID NO: 129 - DNA, 45 bp, Homo sapiens
tgcgccagcagccctagcgggggggccctagagacccagtacttc

SEQ ID NO: 130 - DNA, 42 bp, Homo sapiens
tgcgccagcagcccctcgggacaggggagatcggcgttcttc

SEQ ID NO: 131 - DNA, 51 bp, Homo sapiens
tgcgccagcagcccgagccatacagggaacactggaaacaccatatatttt

SEQ ID NO: 132 - DNA, 39 bp, Homo sapiens
tgcgccagcagcccttccctctacaatgagcagttcttc

SEQ ID NO: 133 - DNA, 45 bp, Homo sapiens
tgcgccagcagcccctcccggggtccatcctacgagcagtacttc

SEQ ID NO: 134 - DNA, 39 bp, Homo sapiens
tgcgccagcagcccgtatacgggaaacaccatatatttt

SEQ ID NO: 135 - DNA, 48 bp, Homo sapiens
tgcgccagcagccaagcattccagggatcgaacactgaagctttcttt

SEQ ID NO: 136 - DNA, 42 bp, Homo sapiens
tgcgccagcagccaagccggggccgcctacgagcagtacttc

SEQ ID NO: 137 - DNA, 51 bp, Homo sapiens
tgcgccagcagccaagccagcggactagcgggaggatacgagcagtacttc

SEQ ID NO: 138 - DNA, 45 bp, Homo sapiens
tgcgccagcagccaagatgagagggtaacagagacccagtacttc

SEQ ID NO: 139 - DNA, 42 bp, Homo sapiens
tgcgccagcagccaagatttcgggagaaccgagcagtacttc

SEQ ID NO: 140 - DNA, 51 bp, Homo sapiens
tgtgccagcagccaagatggggaagggggcgctgactatggctacaccttc

SEQ ID NO: 141 - DNA, 48 bp, Homo sapiens
tgtgccagcagccaagatatcgggacagggccgactgaagctttcttt

SEQ ID NO: 142 - DNA, 48 bp, Homo sapiens
tgcgccagcagccaagatctggggggcagtggaaacaccatatatttt

SEQ ID NO: 143 - DNA, 45 bp, Homo sapiens
tgcgccagcagccaagatctagggccaagcactgaagctttcttt

SEQ ID NO: 144 - DNA, 48 bp, Homo sapiens
tgcgccagcagccaagatcccgggatggagaccggggagctgtttttt

SEQ ID NO: 145 - DNA, 39 bp, Homo sapiens
tgcgccagcagccaagatccgggctacgagcagtacttc

SEQ ID NO: 146 - DNA, 39 bp, Homo sapiens
tgcgccagcagccaagattcagatcagacccaccatttt

SEQ ID NO: 147 - DNA, 48 bp, Homo sapiens
tgtgccagcagccaagatagcgggagctcctacaatgagcagttcttc

SEQ ID NO: 148 - DNA, 45 bp, Homo sapiens
tgcgccagcagccaagatagcggtattggtcagccccagcatttt

SEQ ID NO: 149 - DNA, 45 bp, Homo sapiens
tgcgccagcagccaagattcgggaccctcctacgagcagtacttc

SEQ ID NO: 150 - DNA, 42 bp, Homo sapiens
tgcgccagcagccaggattcgcacaccggggagctgtttttt

SEQ ID NO: 151 - DNA, 39 bp, Homo sapiens
tgcgccagcagccaagattcaaatcagccccagcatttt

SEQ ID NO: 152 - DNA, 54 bp, Homo sapiens
tgcgccagcagccaagattccccactagcgtccagctcctacgagcagtacttc

SEQ ID NO: 153 - DNA, 42 bp, Homo sapiens
tgcgccagcagccaagacacgtaccaagagacccagtacttc

SEQ ID NO: 154 - DNA, 45 bp, Homo sapiens
tgcgccagcagccaagaagacagggtatccgagacccagtacttc

SEQ ID NO: 155 - DNA, 51 bp, Homo sapiens
tgcgccagcagccaagaagagggaggtatgatcaatcagccccagcatttt

SEQ ID NO: 156 - DNA, 42 bp, Homo sapiens
tgcgccagcagccaagaatttgggggtgatgagcagttcttc

SEQ ID NO: 157 - DNA, 51 bp, Homo sapiens
tgcgccagcagccaagaaggagcggggcttagcacagatacgcagtatttt

SEQ ID NO: 158 - DNA, 42 bp, Homo sapiens
tgcgccagcagccaagagggggcctctcatggctacaccttc

SEQ ID NO: 159 - DNA, 54 bp, Homo sapiens
tgtgccagcagccaagaagggcagctagcggaggggggcggggagctgtttttt

SEQ ID NO: 160 - DNA, 42 bp, Homo sapiens
tgcgccagcagccaagaggggaggggcaatgagcagttcttc

SEQ ID NO: 161 - DNA, 45 bp, Homo sapiens
tgcgccagcagccaagaacacaggggattatacgagcagtacttc

SEQ ID NO: 162 - DNA, 51 bp, Homo sapiens
tgcgccagcagccaagaattggggggagggactaagtacgagcagtacttc

SEQ ID NO: 163 - DNA, 45 bp, Homo sapiens
tgcgccagcagccaagagcccgggggggtcgaaaagctgtttttt

SEQ ID NO: 164 - DNA, 48 bp, Homo sapiens
tgtgccagcagccaagagcaagcgggaggggtggttacgcagtatttt

SEQ ID NO: 165 - DNA, 48 bp, Homo sapiens
tgtgccagcagccaagaaaggggggagggccgtgatacgcagtatttt

SEQ ID NO: 166 - DNA, 51 bp, Homo sapiens
tgtgccagcagccaagaaaggggacgaatctctggaaacaccatatatttt

SEQ ID NO: 167 - DNA, 45 bp, Homo sapiens
tgtgccagcagccaagaggtggcgggggtgagggagcagtacttc

SEQ ID NO: 168 - DNA, 48 bp, Homo sapiens
tgcgccagcagccaagaatggcccgaaagcggtcacaccatatatttt

SEQ ID NO: 169 - DNA, 42 bp, Homo sapiens
tgcgccagcagccaaggagccgggggctacgagcagtacttc

SEQ ID NO: 170 - DNA, 45 bp, Homo sapiens
tgcgccagcagccaaggggaccgaaactattcacccctccacttt

SEQ ID NO: 171 - DNA, 45 bp, Homo sapiens
tgcgccagcagccaaggggaccgctatgtcactgaagctttcttt

SEQ ID NO: 172 - DNA, 42 bp, Homo sapiens
tgcgccagcagccaaggggacagctcctacgagcagtacttc

SEQ ID NO: 173 - DNA, 42 bp, Homo sapiens
tgtgccagcagccaagggggggaggggtacgagcagtacttc

SEQ ID NO: 174 - DNA, 45 bp, Homo sapiens
tgcgccagcagccaaggcgggggggaaacctacgagcagtacttc

SEQ ID NO: 175 - DNA, 51 bp, Homo sapiens
tgtgccagcagccaaggcgggggacagggttttatcactgaagctttcttt

SEQ ID NO: 176 - DNA, 39 bp, Homo sapiens
tgtgccagcagccaagggggtcccggggagctgtttttt

SEQ ID NO: 177 - DNA, 42 bp, Homo sapiens
tgcgccagcagccaaggggggacccaagagacccagtacttc

SEQ ID NO: 178 - DNA, 48 bp, Homo sapiens
tgtgccagcagccaaggactagcgggagggccaggtacgcagtatttt

SEQ ID NO: 179 - DNA, 57 bp, Homo sapiens
tgtgccagcagccaagggatgagggctagttggggttttgacaatgagcagttcttc

SEQ ID NO: 180 - DNA, 45 bp, Homo sapiens
tgcgccagcagccaaggacggtatagcaatcagccccagcatttt

SEQ ID NO: 181 - DNA, 48 bp, Homo sapiens
tgcgccagcagccaaggggtcgggcgggctaactatggctacaccttc

SEQ ID NO: 182 - DNA, 48 bp, Homo sapiens
tgtgccagcagccaaaaactagcgggagatacagatacgcagtatttt

SEQ ID NO: 183 - DNA, 51 bp, Homo sapiens
tgtgccagcagccaaaaaccgggactagcgggattcaacgagcagtacttc

SEQ ID NO: 184 - DNA, 42 bp, Homo sapiens
tgcgccagcagccaaaaatggggtaatcacccccagcatttt

SEQ ID NO: 185 - DNA, 57 bp, Homo sapiens
tgcgccagcagccaaaagtacagggttctggaactcggcacagatacgcagtatttt

SEQ ID NO: 186 - DNA, 48 bp, Homo sapiens
tgcgccagcagccaactcgcgggaggggtagcagatacgcagtatttt

SEQ ID NO: 187 - DNA, 51 bp, Homo sapiens
tgcgccagcagccaactcgggacagggggcgcgggggagacccagtacttc

SEQ ID NO: 188 - DNA, 48 bp, Homo sapiens
tgcgccagcagccagccgggactagcgggatatgatgagcagttcttc

SEQ ID NO: 189 - DNA, 45 bp, Homo sapiens
tgcgccagcagccagcctctgggacagaaagagacccagtacttc

SEQ ID NO: 190 - DNA, 45 bp, Homo sapiens
tgcgccagcagccaaagggcggttggggactatggctacaccttc

SEQ ID NO: 191 - DNA, 48 bp, Homo sapiens
tgcgccagcagccaacgcgggactagcgggaagaatgagcagttcttc

SEQ ID NO: 192 - DNA, 42 bp, Homo sapiens
tgcgccagcagccaacgacaaactggctacgagcagtacttc

SEQ ID NO: 193 - DNA, 54 bp, Homo sapiens
tgcgccagcagccaatcgttagctgtagctacctcctacaatgagcagttcttc

SEQ ID NO: 194 - DNA, 48 bp, Homo sapiens
tgcgccagcagccagaccgggagggggccctcctacgagcagtacttc

SEQ ID NO: 195 - DNA, 42 bp, Homo sapiens
tgcgccagcagccaaaccgggacttcctacgagcagtacttc

SEQ ID NO: 196 - DNA, 48 bp, Homo sapiens
tgcgccagcagccaagtgcgaagcgggggagcctacgagcagtacttc

SEQ ID NO: 197 - DNA, 45 bp, Homo sapiens
tgcgccagcagccaagtatcagaagctaactatggctacaccttc

SEQ ID NO: 198 - DNA, 45 bp, Homo sapiens
tgcgccagcagccaagtgacagggggctcctatggctacaccttc

SEQ ID NO: 199 - DNA, 48 bp, Homo sapiens
tgcgccagcagccaggtaacggggacagggcgatacgagcagtacttc

SEQ ID NO: 200 - DNA, 39 bp, Homo sapiens
tgcgccagcagccaagttacatcctacgagcagtacttc

SEQ ID NO: 201 - DNA, 48 bp, Homo sapiens
tgcgccagcagccggggactagcgggaggacacaatgagcagttcttc

SEQ ID NO: 202 - DNA, 54 bp, Homo sapiens
tgcgccagcagctcagacactagcgggagcaccaggggcaatgagcagttcttc

SEQ ID NO: 203 - DNA, 39 bp, Homo sapiens
tgcgccagcagttccagggggtggaagacccagtacttc

SEQ ID NO: 204 - DNA, 42 bp, Homo sapiens
tgtgccagcagcacatcgtctcgcgacaatgagcagttcttc

SEQ ID NO: 205 - DNA, 45 bp, Homo sapiens
tgtgccagcagctacgacagggagactaatgaaaaactgtttttt

SEQ ID NO: 206 - DNA, 42 bp, Homo sapiens
tgcgccagcagctactaccaggggggcggcgagcagtacttc

SEQ ID NO: 207 - DNA, 45 bp, Homo sapiens
tgtgcctgcagctttggggaacggggctacaatgggcagttcttc

SEQ ID NO: 208 - DNA, 57 bp, Homo sapiens
tgtgccaacccgccgatcgtgggagcggttgtgtctggggccaacgtcctgactttc

SEQ ID NO: 209 - DNA, 45 bp, Homo sapiens
tgtgccaacagctttggggaccgggccaacaatgaacagttcttc

SEQ ID NO: 210 - DNA, 45 bp, Homo sapiens
tgtgcccccagctttggggacagggcctacagtgacaagttcttc

SEQ ID NO: 211 - DNA, 42 bp, Homo sapiens
tgtgccagagaagggcaggggccctacaatgagcagttcttc

SEQ ID NO: 212 - DNA, 39 bp, Homo sapiens
tgtgcccgcagctttgcctccggctatgaacaattcttc

SEQ ID NO: 213 - DNA, 36 bp, Homo sapiens
tgtgccagtgaaggagggcccgatgagcagttcttc

SEQ ID NO: 214 - DNA, 45 bp, Homo sapiens
tgtgccagcgggacactagcgaccagcacagatacgcagtatttt

SEQ ID NO: 215 - DNA, 42 bp, Homo sapiens
tgcgccagccaccaagcggggggctacactgaagctttcttt

SEQ ID NO: 216 - DNA, 45 bp, Homo sapiens
tgcgccagcaaactagcggggggaacccaagagacccagtacttc

SEQ ID NO: 217 - DNA, 36 bp, Homo sapiens
tgcgccagcatggtgggagacactgaagctttcttt

SEQ ID NO: 218 - DNA, 45 bp, Homo sapiens
tgtgccagcaaccttggcctcaacccctacaatgagcagttcttc

SEQ ID NO: 219 - DNA, 45 bp, Homo sapiens
tgtgccagcccttttggggacaggccctaccatgagcagttcttc

SEQ ID NO: 220 - DNA, 42 bp, Homo sapiens
tgtgccagcagggatgaggggttgtggaatgagcagttcttc

SEQ ID NO: 221 - DNA, 39 bp, Homo sapiens
tgcgccagcaggggggaatcctacaatgagcagttcttc

SEQ ID NO: 222 - DNA, 36 bp, Homo sapiens
tgtgccagcaggatccagggctacgagcagtacttc

SEQ ID NO: 223 - DNA, 45 bp, Homo sapiens
tgcgccagcagattgggtgagagctcctacaatgagcagttcttc

SEQ ID NO: 224 - DNA, 45 bp, Homo sapiens
tgtgccagcaggctacgggactttacctacaatgagcagttcttc

SEQ ID NO: 225 - DNA, 45 bp, Homo sapiens
tgtgccagcagacccctagcagagatctacaatgagcagttcttc

SEQ ID NO: 226 - DNA, 42 bp, Homo sapiens
tgtgccagcaggccccctcgacagacagatacgcagtatttt

SEQ ID NO: 227 - DNA, 39 bp, Homo sapiens
tgcgccagcagacaagggactactaatgagcagttcttc

SEQ ID NO: 228 - DNA, 42 bp, Homo sapiens
tgcgccagcagacggcgggacgacacagatacgcagtatttt

SEQ ID NO: 229 - DNA, 51 bp, Homo sapiens
tgtgccagcagcgccggggggtttagcgggagagggctcgagcagtacttc

SEQ ID NO: 230 - DNA, 48 bp, Homo sapiens
tgcgccagcagcgcctcagcgggagttgaagcagatacgcagtatttt

SEQ ID NO: 231 - DNA, 40 bp, Homo sapiens
tgcgccagcagcgcgtcagggggctacaatgagcagttct

SEQ ID NO: 232 - DNA, 54 bp, Homo sapiens
tgtgccagcagcgaaaattcccctctagcgggaggtagaaatgagcagttcttc

SEQ ID NO: 233 - DNA, 45 bp, Homo sapiens
tgtgccagcagcttcgcgggctccagctcctacgagcagtacttc

SEQ ID NO: 234 - DNA, 42 bp, Homo sapiens
tgtgccagcagctttgacaaaaactcctacgagcagtacttc

SEQ ID NO: 235 - DNA, 48 bp, Homo sapiens
tgtgccagcagctttgaagcgggaggctcctacaatgagcagttcttc

SEQ ID NO: 236 - DNA, 33 bp, Homo sapiens
tgcgccagcagctttttcaatgagcagttcttc

SEQ ID NO: 237 - DNA, 45 bp, Homo sapiens
tgtgccagcagctttggggctagcgggggctacgagcagtacttc

SEQ ID NO: 238 - DNA, 45 bp, Homo sapiens
tgtgccagcagcttcggggacatcggctcctacgagcagtacttc

SEQ ID NO: 239 - DNA, 45 bp, Homo sapiens
tgtgccagcagctttggggacagggccaacaatgagcagttcttc

SEQ ID NO: 240 - DNA, 45 bp, Homo sapiens
tgtgccagcagctttggggacagggcctacaatgagcagttcttc

SEQ ID NO: 241 - DNA, 45 bp, Homo sapiens
tgtgccagcagctttggggacagggcctactatgagcagttcttc

SEQ ID NO: 242 - DNA, 45 bp, Homo sapiens
tgtgccagcagctttggggacagggactacaatgagcagttcttc

SEQ ID NO: 243 - DNA, 45 bp, Homo sapiens
tgtgccagcagctttgggggcagggcctacaatgagcagtccttc

SEQ ID NO: 244 - DNA, 48 bp, Homo sapiens
tgcgccagcagcttcgggacagcgaccgaaggctatggctacaccttc

SEQ ID NO: 245 - DNA, 36 bp, Homo sapiens
tgtgccagcagctttgggacggaaaaagctttcttt

SEQ ID NO: 246 - DNA, 45 bp, Homo sapiens
tgtgccagcagcttcgggacaggggcccttggggagcagtacttc

SEQ ID NO: 247 - DNA, 45 bp, Homo sapiens
tgcgccagcagcttcctagcgggtttatacaatgagcagttcttc

SEQ ID NO: 248 - DNA, 45 bp, Homo sapiens
tgtgccagcagctttctgggactaagatacaatgagcagttcttc

SEQ ID NO: 249 - DNA, 42 bp, Homo sapiens
tgtgccagcagctttttgggcagcggggagacccagtacttc

SEQ ID NO: 250 - DNA, 39 bp, Homo sapiens
tgcgccagcagctttaactctggaaacaccatatatttt

SEQ ID NO: 251 - DNA, 39 bp, Homo sapiens
tgtgccagcagcttcccaggacttaacgagcagtacttc

SEQ ID NO: 252 - DNA, 45 bp, Homo sapiens
tgtgccagcagcttccccgggacagggggccacgagcagtacttc

SEQ ID NO: 253 - DNA, 48 bp, Homo sapiens
tgtgccagcagctttccgaaccacctgagctcctacgagcagtacttc

SEQ ID NO: 254 - DNA, 45 bp, Homo sapiens
tgcgccagcagctttcccacagggggcagggatgagcagttcttc

SEQ ID NO: 255 - DNA, 45 bp, Homo sapiens
tgtgccagcagcttccgggacggaacccaagagacccagtacttc

SEQ ID NO: 256 - DNA, 45 bp, Homo sapiens
tgtgccagcagcttccgggacagaccgaaagagacccagtacttc

SEQ ID NO: 257 - DNA, 45 bp, Homo sapiens
tgcgccagcagcttccgggacagaagctcctacgagcagtacttc

SEQ ID NO: 258 - DNA, 42 bp, Homo sapiens
tgcgccagcagcttccgggacacctacaatgagcagttcttc

SEQ ID NO: 259 - DNA, 45 bp, Homo sapiens
tgtgccagcagcttcagggggtcgggcaatcagccccagcatttt

SEQ ID NO: 260 - DNA, 42 bp, Homo sapiens
tgtgccagcagcttccgactatcctacaatgagcagttcttc

SEQ ID NO: 261 - DNA, 42 bp, Homo sapiens
tgcgccagcagctttagcggggcctacaatgagcagttcttc

SEQ ID NO: 262 - DNA, 42 bp, Homo sapiens
tgcgccagcagctttagcggggcctacaatgagcggttcttc

SEQ ID NO: 263 - DNA, 51 bp, Homo sapiens
tgcgccagcagcttctcagggacgtccgatttttacaatgagcagttcttc

SEQ ID NO: 264 - DNA, 36 bp, Homo sapiens
tgtgccagcagctttagtaacactgaagctttcttt

SEQ ID NO: 265 - DNA, 60 bp, Homo sapiens
tgtgccagcagcttttcgcctgggggacagcctctctctggggccaacgtcctgactttc

SEQ ID NO: 266 - DNA, 45 bp, Homo sapiens
tgcgccagcagcttcacagggggcgatgcggaaaaactgtttttt

SEQ ID NO: 267 - DNA, 45 bp, Homo sapiens
tgcgccagcagctttgtggggaagccctacaatgagcagttcttc

SEQ ID NO: 268 - DNA, 45 bp, Homo sapiens
tgtgccagcagcgggggacaggggaccgtctacgagcagtacttc

SEQ ID NO: 269 - DNA, 36 bp, Homo sapiens
tgtgccagcagcgggggccgcactgaatctttcttt

SEQ ID NO: 270 - DNA, 36 bp, Homo sapiens
tgcgccagcagcgggggctcctacgagcagtacttc

SEQ ID NO: 271 - DNA, 42 bp, Homo sapiens
tgcgccagcagcggaactagcgggagagatacgcagtatttt

SEQ ID NO: 272 - DNA, 48 bp, Homo sapiens
tgcgccagcagccacgggtccgacggaccacaagagacccagtacttc

SEQ ID NO: 273 - DNA, 42 bp, Homo sapiens
tgcgccagcagccacgggacagggagcggtggctacaccttc

SEQ ID NO: 274 - DNA, 45 bp, Homo sapiens
tgtgccagcagtatcgggggtagcgggatcgagacccagtacttc

SEQ ID NO: 275 - DNA, 42 bp, Homo sapiens
tgtgccagcagcttggcggggggggaggagacccagtacttc

SEQ ID NO: 276 - DNA, 42 bp, Homo sapiens
tgcgccagcagcttggccggcggatacaatgagcagttcttc

SEQ ID NO: 277 - DNA, 42 bp, Homo sapiens
tgcgccagcagcttggcagggggctacactgaagctttcttt

SEQ ID NO: 278 - DNA, 42 bp, Homo sapiens
tgcgccagcagcttggcaggagggtacgttgagcagttcttc

SEQ ID NO: 279 - DNA, 48 bp, Homo sapiens
tgtgccagcagcttagcagggttgattaacaccggggagctgtttttt

SEQ ID NO: 280 - DNA, 42 bp, Homo sapiens
tgcgccagcagcttggcaggcagtgactatggctacaccttc

SEQ ID NO: 281 - DNA, 45 bp, Homo sapiens
tgtgccagcagcttggccatgaggtaccaagagacccagtacttc

SEQ ID NO: 282 - DNA, 39 bp, Homo sapiens
tgtgccagcagcttggccccagcctacgagcagtacttc

SEQ ID NO: 283 - DNA, 45 bp, Homo sapiens
tgtgccagcagcttggccccgggagtggggaatgagcagttcttc

SEQ ID NO: 284 - DNA, 66 bp, Homo sapiens
tgcgccagcagcttggcgagaggatggactagcgggctttttccttctctaaatgagcagttcttc

SEQ ID NO: 285 - DNA, 42 bp, Homo sapiens
tgtgccagcagcttagctagcggggaagagacccagtacttc

SEQ ID NO: 286 - DNA, 39 bp, Homo sapiens
tgcgccagcagcttggcgacggactacgagcagtacttc

SEQ ID NO: 287 - DNA, 42 bp, Homo sapiens
tgcgccagcagcttggcgacaggatcctacgagcagtacttc

SEQ ID NO: 288 - DNA, 45 bp, Homo sapiens
tgtgccagcagcttggccgtcgggagcgcagatacgcagtatttt

SEQ ID NO: 289 - DNA, 60 bp, Homo sapiens
tgcgccagcagcttagcgtaccgggacagggtagcccttacttacaatgagcagttcttc

SEQ ID NO: 290 - DNA, 42 bp, Homo sapiens
tgtgccagcagcttggcttacgttaactatggctactccttc

SEQ ID NO: 291 - DNA, 42 bp, Homo sapiens
tgtgccagcagcttggcttacgttaactatggctacaccttc

SEQ ID NO: 292 - DNA, 36 bp, Homo sapiens
tgcgccagcagcttggatgatagcattcagtacttc

SEQ ID NO: 293 - DNA, 48 bp, Homo sapiens
tgcgccagcagcttggattttggaataaccgcagatacgcagtatttt

SEQ ID NO: 294 - DNA, 42 bp, Homo sapiens
tgcgccagcagcttggatggcggaccctacgagcagtacttc

SEQ ID NO: 295 - DNA, 42 bp, Homo sapiens
tgtgccagcagcctggacggaaacaatcagccccagcatttt

SEQ ID NO: 296 - DNA, 45 bp, Homo sapiens
tgcgccagcagcttggacaactctggggccaacgtcctgactttc

SEQ ID NO: 297 - DNA, 42 bp, Homo sapiens
tgtgccagcagcttggacagggcctgggaaacgcagtatttt

SEQ ID NO: 298 - DNA, 39 bp, Homo sapiens
tgtgccagcagcttggacaggggggagacccagtacttc

SEQ ID NO: 299 - DNA, 39 bp, Homo sapiens
tgcgccagcagcttggactcctgcaatgagcagttcttc

SEQ ID NO: 300 - DNA, 39 bp, Homo sapiens
tgcgccagcagcttggactcctacaatgagcagttcttc

SEQ ID NO: 301 - DNA, 54 bp, Homo sapiens
tgtgccagcagcttggaagctggcgggacagggtaccaagagacccagtacttc

SEQ ID NO: 302 - DNA, 45 bp, Homo sapiens
tgcgccagcagcttggagggggcagggttgaatacgcagtatttt

SEQ ID NO: 303 - DNA, 45 bp, Homo sapiens
tgtgccagcagcttggagggaccgggggacactgaagctttcttt

SEQ ID NO: 304 - DNA, 39 bp, Homo sapiens
tgcgccagcagcttggaaggacaagagacccagtacttc

SEQ ID NO: 305 - DNA, 51 bp, Homo sapiens
tgtgccagcagcttggagggcagcgggagggcctatcgagagcagttcttc

SEQ ID NO: 306 - DNA, 45 bp, Homo sapiens
tgtgccagcagcttggagtctgccttgacagatacgcagtatttt

SEQ ID NO: 307 - DNA, 39 bp, Homo sapiens
tgcgccagcagcttggagtccagggacgagcagtacttc

SEQ ID NO: 308 - DNA, 42 bp, Homo sapiens
tgtgccagcagcttgtttagcgggagttacgagcagtacttc

SEQ ID NO: 309 - DNA, 51 bp, Homo sapiens
tgtgccagcagcttgtttgtgcgggaggggtcctacaatgagcagttcttc

SEQ ID NO: 310 - DNA, 51 bp, Homo sapiens
tgcgccagcagcttgggggcgggagggccttttggctacgagcagtacttc

SEQ ID NO: 311 - DNA, 54 bp, Homo sapiens
tgcgccagcagcttgggagcgggaatccaaaaggggtacaatgagcagttcttc

SEQ ID NO: 312 - DNA, 48 bp, Homo sapiens
tgcgccagcagcttgggtgacgggagctccacagatacgcagtatttt

SEQ ID NO: 313 - DNA, 48 bp, Homo sapiens
tgtgccagcagcttgggggacagggggctgggagagacccagtacttc

SEQ ID NO: 314 - DNA, 45 bp, Homo sapiens
tgtgccagcagcttgggggacagggacaactatgatgagttcttc

SEQ ID NO: 315 - DNA, 51 bp, Homo sapiens
tgtgccagcagcttgggggggcctagcgggagttccggggagctgtttttt

SEQ ID NO: 316 - DNA, 48 bp, Homo sapiens
tgtgccagcagcttggggggacagggactgaacactgaagctttcttt

SEQ ID NO: 317 - DNA, 48 bp, Homo sapiens
tgcgccagcagcttgggtatcggtggctcctacaatgagcagttcttc

SEQ ID NO: 318 - DNA, 48 bp, Homo sapiens
tgcgccagcagcttggggcctgattggcacaccggggagctgtttttt

SEQ ID NO: 319 - DNA, 48 bp, Homo sapiens
tgcgccagcagcttgggaccggaccgtggggtcaatgagcagttcttc

SEQ ID NO: 320 - DNA, 42 bp, Homo sapiens
tgcgccagcagcttgggaccgacactccatggctacaccttc

SEQ ID NO: 321 - DNA, 45 bp, Homo sapiens
tgtgccagcagcttaggacagggctctggaaacaccatatatttt

SEQ ID NO: 322 - DNA, 42 bp, Homo sapiens
tgtgccagcagcttgggcaggggctacgaaaaactgtttttt

SEQ ID NO: 323 - DNA, 51 bp, Homo sapiens
tgtgccagcagcttggggcgactatcacatggcgcagatacgcagtatttt

SEQ ID NO: 324 - DNA, 48 bp, Homo sapiens
tgcgccagcagcttgggaagcgctttctctggaaacaccatatatttt

SEQ ID NO: 325 - DNA, 48 bp, Homo sapiens
tgtgccagcagcttggggtcaggggggtttggtactgaagctttcttt

SEQ ID NO: 326 - DNA, 60 bp, Homo sapiens
tgcgccagcagcttgggttcaggggggaatccaagctctggggccaacgtcctgactttc

SEQ ID NO: 327 - DNA, 48 bp, Homo sapiens
tgcgccagcagcttgggatcgggggggccttacactgaagctttcttt

SEQ ID NO: 328 - DNA, 54 bp, Homo sapiens
tgtgccagcagcttgggttcccggccacgcttgaacaccggggagctgtttttt

SEQ ID NO: 329 - DNA, 48 bp, Homo sapiens
tgcgccagcagcttggggacagggggcttgtacactgaagctttcttt

SEQ ID NO: 330 - DNA, 42 bp, Homo sapiens
tgcgccagcagcttggggacagggggctatggctacaccttc

SEQ ID NO: 331 - DNA, 45 bp, Homo sapiens
tgcgccagcagcctcgggacagggagggcagatacgcagtatttt

SEQ ID NO: 332 - DNA, 45 bp, Homo sapiens
tgcgccagcagcttgggtacagggcgggacgatgagcagttcttc

SEQ ID NO: 333 - DNA, 45 bp, Homo sapiens
tgcgccagcagcttggggaccaccgaactagcgggggagttcttc

SEQ ID NO: 334 - DNA, 42 bp, Homo sapiens
tgtgccagcagccttgggacgtggaactacgagcagtacttc

SEQ ID NO: 335 - DNA, 48 bp, Homo sapiens
tgtgccagcagcttgggggtagcgggaggtttgaacgagcagtacttc

SEQ ID NO: 336 - DNA, 45 bp, Homo sapiens
tgtgccagcagcttgggtgtttcagggttgaagacccagtacttc

SEQ ID NO: 337 - DNA, 42 bp, Homo sapiens
tgtgccagcagcttaggcgttagcgggagcgagcagtacttc

SEQ ID NO: 338 - DNA, 42 bp, Homo sapiens
tgtgccagcagcttgggtgtgagttacactgaagctttcttt

SEQ ID NO: 339 - DNA, 48 bp, Homo sapiens
tgcgccagcagcttggggtggcgggagacttacgatgagcacttcttc

SEQ ID NO: 340 - DNA, 48 bp, Homo sapiens
tgcgccagcagcttggggtggcgggagacttacgatgagcagttcttc

SEQ ID NO: 341 - DNA, 48 bp, Homo sapiens
tgcgccagcagcttggggtggcgggagacttacaatgagcagttcttc

SEQ ID NO: 342 - DNA, 54 bp, Homo sapiens
tgtgccagcagcctcattcccgtgggggtaacgagttatcatgagcagttcttc

SEQ ID NO: 343 - DNA, 45 bp, Homo sapiens
tgtgccagcagcttgttagcagggggaaactatggctacaccttc

SEQ ID NO: 344 - DNA, 45 bp, Homo sapiens
tgcgccagcagcttgttggggggcttgggcactgaagctttcttt

SEQ ID NO: 345 - DNA, 48 bp, Homo sapiens
tgcgccagcagcctcttggggagcgccaaatacaatgagcagttcttc

SEQ ID NO: 346 - DNA, 45 bp, Homo sapiens
tgcgccagcagcctcttgaaggagaaggcagatacgcagtatttt

SEQ ID NO: 347 - DNA, 45 bp, Homo sapiens
tgcgccagcagcttgttacgggagcatcaagatacgcagtatttt

SEQ ID NO: 348 - DNA, 45 bp, Homo sapiens
tgcgccagcagcttgttacgggagcatcgagatacgcagtatttt

SEQ ID NO: 349 - DNA, 45 bp, Homo sapiens
tgcgccagcagcctcttgagggagaaggcagatacgcagtatttt

SEQ ID NO: 350 - DNA, 45 bp, Homo sapiens
tgcgccagcagcttgttgcgggaaagcacagatacgcagtatttt

SEQ ID NO: 351 - DNA, 45 bp, Homo sapiens
tgtgccagcagcttgctatcgggagggggggagacccagtacttc

SEQ ID NO: 352 - DNA, 42 bp, Homo sapiens
tgtgccagcagcctgatggagggtagctatggctacaccttc

SEQ ID NO: 353 - DNA, 45 bp, Homo sapiens
tgcgccagcagcttgaatgcactagcggtgaatgagcagttcttc

SEQ ID NO: 354 - DNA, 39 bp, Homo sapiens
tgtgccagcagcttgaatgaagaagagacccagtacttc

SEQ ID NO: 355 - DNA, 54 bp, Homo sapiens
tgtgccagcagcttgcgagcggggtgggaagaagacacagatacgcagtatttt

SEQ ID NO: 356 - DNA, 45 bp, Homo sapiens
tgtgccagcagcttacgggcgggagggctagacgagcagtacttc

SEQ ID NO: 357 - DNA, 48 bp, Homo sapiens
tgcgccagcagcttgcgattatacagccataacactgaagctttcttt

SEQ ID NO: 358 - DNA, 39 bp, Homo sapiens
tgtgccagcagcctacgacagtcccccgagcagtacttc

SEQ ID NO: 359 - DNA, 33 bp, Homo sapiens
tgtgccagcagcttgcgcagggagcagttcttc

SEQ ID NO: 360 - DNA, 42 bp, Homo sapiens
tgcgccagcagcttgtcagggggctacaatgagcagttcttc

SEQ ID NO: 361 - DNA, 48 bp, Homo sapiens
tgtgccagcagcttatcgggactagcgggagttcgtgagcagttcttc

SEQ ID NO: 362 - DNA, 48 bp, Homo sapiens
tgcgccagcagcttgtcgggcaggaaggtatcctacgagcagtacttc

SEQ ID NO: 363 - DNA, 36 bp, Homo sapiens
tgtgccagcagcttaagcagggggcgagctttcttt

SEQ ID NO: 364 - DNA, 48 bp, Homo sapiens
tgcgccagcagcttgtcgagcgatatctcccaagagacccagtacttc

SEQ ID NO: 365 - DNA, 36 bp, Homo sapiens
tgtgccagcagcttaactgcctacgagcagtacttc

SEQ ID NO: 366 - DNA, 45 bp, Homo sapiens
tgcgccagcagcttgaccgggggctcctacaatgagcagttcttc

SEQ ID NO: 367 - DNA, 39 bp, Homo sapiens
tgtgccagcagcttggtgggggaaagggagcagttcttc

SEQ ID NO: 368 - DNA, 45 bp, Homo sapiens
tgcgccagcagcttggttggcgggagattcgagacccagtacttc

SEQ ID NO: 369 - DNA, 39 bp, Homo sapiens
tgcgccagcagcttggtggggatcgagacccagtacttc

SEQ ID NO: 370 - DNA, 33 bp, Homo sapiens
tgtgccagcagcttggtacttgagcagttcttc

SEQ ID NO: 371 - DNA, 45 bp, Homo sapiens
tgtgccagcagcttgtgggacggcggtgaagagacccagtacttc

SEQ ID NO: 372 - DNA, 48 bp, Homo sapiens
tgcgccagcagcttgtggacccgtatttaccaagagacccagtacttc

SEQ ID NO: 373 - DNA, 48 bp, Homo sapiens
tgcgccagcagcttgtatttgggggtgaggggacatgagcagttcttc

SEQ ID NO: 374 - DNA, 48 bp, Homo sapiens
tgtgccagcagcttgtatcctttgagctcctacaatgagcagttcttc

SEQ ID NO: 375 - DNA, 45 bp, Homo sapiens
tgtgccagcagcatgtttctggtgggggctgagacccagtacttc

SEQ ID NO: 376 - DNA, 36 bp, Homo sapiens
tgcgccagcagtaatgacttcactgaagctttcttt

SEQ ID NO: 377 - DNA, 36 bp, Homo sapiens
tgcgccagcagcccggccgactacgagcagtacttc

SEQ ID NO: 378 - DNA, 45 bp, Homo sapiens
tgtgccagcagccccgcgggactagcggactacgagcagtacttc

SEQ ID NO: 379 - DNA, 42 bp, Homo sapiens
tgtgccagcagccccgacgccagggacgatgagcagttcttc

SEQ ID NO: 380 - DNA, 39 bp, Homo sapiens
tgcgccagcagccctttttacaacactgaagctttcttt

SEQ ID NO: 381 - DNA, 45 bp, Homo sapiens
tgtgccagcagccccggacagggtctggtcaatgagcagttcttc

SEQ ID NO: 382 - DNA, 45 bp, Homo sapiens
tgcgccagcagccccggacgggagaacaccggggagctgtttttt

SEQ ID NO: 383 - DNA, 42 bp, Homo sapiens
tgcgccagcagccctgggacaggggtagccgagcagtacttc

SEQ ID NO: 384 - DNA, 42 bp, Homo sapiens
tgtgccagcagcccagggtggggggcctacgagcagtacttc

SEQ ID NO: 385 - DNA, 48 bp, Homo sapiens
tgtgccagcagcccgctagtagggggaacctacaatgagcagttcttc

SEQ ID NO: 386 - DNA, 45 bp, Homo sapiens
tgtgccagcagccccccgacagggagggccggggagctgtttttt

SEQ ID NO: 387 - DNA, 42 bp, Homo sapiens
tgcgccagcagtcctagcgggggttacaatgagcagttcttc

SEQ ID NO: 388 - DNA, 45 bp, Homo sapiens
tgcgccagcagccccgtctcccctaccagggagacccagtacttc

SEQ ID NO: 389 - DNA, 48 bp, Homo sapiens
tgtgccagcagcccttggggcggggggcgagccggggagctgtttttt

SEQ ID NO: 390 - DNA, 42 bp, Homo sapiens
tgcgccagcagcccgtggactagcgggagggccgggttcttc

SEQ ID NO: 391 - DNA, 45 bp, Homo sapiens
tgtgccagcagccagggacaccgctcctacaatgagcagttcttc

SEQ ID NO: 392 - DNA, 48 bp, Homo sapiens
tgtgccagcagccagggactagcgggcccctacaatgagcagttcttc

SEQ ID NO: 393 - DNA, 42 bp, Homo sapiens
tgtgccagcagccgcatagggggttcagatacgcagtatttt

SEQ ID NO: 394 - DNA, 57 bp, Homo sapiens
tgcgccagcagccgaataccactaacaagcgggagggccgattgggagcagtacttc

SEQ ID NO: 395 - DNA, 45 bp, Homo sapiens
tgcgccagcagccgaatgggacagggacggactgaagctttcttt

SEQ ID NO: 396 - DNA, 45 bp, Homo sapiens
tgcgccagcagcaggaggggcgccgaccgtaatgagcagttcttc

SEQ ID NO: 397 - DNA, 42 bp, Homo sapiens
tgcgccagcagctcagcgggaggctacaatgagcagttcttc

SEQ ID NO: 398 - DNA, 48 bp, Homo sapiens
tgtgccagcagctccgagggcctctctggggccaacgtcctgactttc

SEQ ID NO: 399 - DNA, 42 bp, Homo sapiens
tgcgccagcagctcgggacagggtacctacgagcagtacttc

SEQ ID NO: 400 - DNA, 48 bp, Homo sapiens
tgtgccagcagctcagggacagacttttccacagatacgcagtatttt

SEQ ID NO: 401 - DNA, 45 bp, Homo sapiens
tgtgccagcagctctatagcgggagctggcaatgagcagttcttc

SEQ ID NO: 402 - DNA, 36 bp, Homo sapiens
tgtgccagcagctccatatccgagacccagtacttc

SEQ ID NO: 403 - DNA, 51 bp, Homo sapiens
tgtgccagcagttctattgtctcgcgccctagcacagatacgcagtatttt

SEQ ID NO: 404 - DNA, 51 bp, Homo sapiens
tgcgccagcagctccctgctagcggggatagacaccggggagctgtttttt

SEQ ID NO: 405 - DNA, 45 bp, Homo sapiens
tgtgccagcagctccccaggacaggggacctacgagcagtacttc

SEQ ID NO: 406 - DNA, 39 bp, Homo sapiens
tgcgccagcagctccccccctagtaatgagcagttcttc

SEQ ID NO: 407 - DNA, 48 bp, Homo sapiens
tgtgccagcagctccccgactagcgggacctcctacgagcagtacttc

SEQ ID NO: 408 - DNA, 45 bp, Homo sapiens
tgtgccagcagttctcagcgggagggcctctacgagcagtacttc

SEQ ID NO: 409 - DNA, 39 bp, Homo sapiens
tgtgccagcagctctagcgaggcctacgagcagtacttc

SEQ ID NO: 410 - DNA, 42 bp, Homo sapiens
tgcgccagcagctctagcggggcctacaatgagcagttcttc

SEQ ID NO: 411 - DNA, 48 bp, Homo sapiens
tgtgccagcagctcctcaaaaaggatattgaacactgaagctttcttt

SEQ ID NO: 412 - DNA, 45 bp, Homo sapiens
tgtgccagcagctcgactagcgggagtccagatacgcagtatttt

SEQ ID NO: 413 - DNA, 48 bp, Homo sapiens
tgtgccagcagctcgactagcgtgagctcctacaatgagcagttcttc

SEQ ID NO: 414 - DNA, 39 bp, Homo sapiens
tgtgccagcagcacgaggacggaggagacccagtacttc

SEQ ID NO: 415 - DNA, 42 bp, Homo sapiens
tgcgccagcagtacttccggggcctacaatgagcagttcttc

SEQ ID NO: 416 - DNA, 48 bp, Homo sapiens
tgcgccagcagcacgactagcgggaggaacaccggggagctgtttttt

SEQ ID NO: 417 - DNA, 42 bp, Homo sapiens
tgcgccagcagcgtcgcgggatccacagatacgcagtatttt

SEQ ID NO: 418 - DNA, 33 bp, Homo sapiens
tgcgccagcagcgtcggtgaggagcagtacttc

SEQ ID NO: 419 - DNA, 45 bp, Homo sapiens
tgcgccagcagctgggccgggacagggggctatggctacaccttc

SEQ ID NO: 420 - DNA, 39 bp, Homo sapiens
tgcgccagcagctgggacagggtctatgagcagttcttc

SEQ ID NO: 421 - DNA, 51 bp, Homo sapiens
tgtgccagcagctgggggggggcctactcatcccaagagacccagtacttc

SEQ ID NO: 422 - DNA, 48 bp, Homo sapiens
tgcgccagcagctggggggggcgggaaacttacaatgagcagttcttc

SEQ ID NO: 423 - DNA, 42 bp, Homo sapiens
tgcgccagcagctgggggacaggggccggggagcagttcttc

SEQ ID NO: 424 - DNA, 42 bp, Homo sapiens
tgcgccagcagctgggggacaggttccggtgaccagttcttc

SEQ ID NO: 425 - DNA, 42 bp, Homo sapiens
tgcgccagcagctgggggacagggtccggtgagcagttcttc

SEQ ID NO: 426 - DNA, 48 bp, Homo sapiens
tgtgccagcagctggaagggacgccgccgcacagatacgcagtatttt

SEQ ID NO: 427 - DNA, 42 bp, Homo sapiens
tgtgccagcagctggtcagccgctaactatggctacaccttc

SEQ ID NO: 428 - DNA, 39 bp, Homo sapiens
tgtgccagcagctatgggggcttctacgagcagtacttc

SEQ ID NO: 429 - DNA, 39 bp, Homo sapiens
tgtgccagcagctacgggactgccactgaagctttcttt

SEQ ID NO: 430 - DNA, 42 bp, Homo sapiens
tgcgccagcagctacgggacagggtccactgaagctttcttt

SEQ ID NO: 431 - DNA, 36 bp, Homo sapiens
tgtgccagcagctacctcaatcagccccagcatttt

SEQ ID NO: 432 - DNA, 45 bp, Homo sapiens
tgtgccagcaccaagacaggccttaagggggagacccagtacttc

SEQ ID NO: 433 - DNA, 42 bp, Homo sapiens
tgcgccagcaccctggccggagcctacaatgagcagttcttc

SEQ ID NO: 434 - DNA, 42 bp, Homo sapiens
tgcgccagcactccgggcggggggtacaatgagcagttcttc

SEQ ID NO: 435 - DNA, 42 bp, Homo sapiens
tgtgccagcaccccccggggatccctaggggagctgtttttt

SEQ ID NO: 436 - DNA, 45 bp, Homo sapiens
tgtgccacctcctttggggaccgggcctacaatgaccagttcttc

SEQ ID NO: 437 - DNA, 45 bp, Homo sapiens
tgtgccaccagctttggggacagggcctacaatgagcagttcttc

SEQ ID NO: 438 - DNA, 42 bp, Homo sapiens
tgtgccgtaaggaccgagggggcgatcaatgagcagttcttc

SEQ ID NO: 439 - DNA, 39 bp, Homo sapiens
tgtgccggcagtggtacagagaacactgaagctttcttt

SEQ ID NO: 440 - DNA, 36 bp, Homo sapiens
tgtgccattcgaggggatacctacgagcagtacttc

SEQ ID NO: 441 - DNA, 42 bp, Homo sapiens
tgtgccatctcgtctcagggtttggaaaacgagcagtacttc

SEQ ID NO: 442 - DNA, 42 bp, Homo sapiens
tgtgccagcgcgatagcgggagggataaatgagcagttcttc

SEQ ID NO: 443 - DNA, 51 bp, Homo sapiens
tgtgccagcgcaaagcgtgtgggactagcggactacaatgagcagttcttc

SEQ ID NO: 444 - DNA, 45 bp, Homo sapiens
tgtgccagcgcttcggggggggacagctcctacgagcagtacttc

SEQ ID NO: 445 - DNA, 21 bp, Homo sapiens
tgtgccagtgaagctttcttt

SEQ ID NO: 446 - DNA, 36 bp, Homo sapiens
tgtgccagcgaggcagttaatgaaaaactgtttttt

SEQ ID NO: 447 - DNA, 36 bp, Homo sapiens
tgtgccagcggagccgggctgatgacccagtacttc

SEQ ID NO: 448 - DNA, 36 bp, Homo sapiens
tgtgccagtggggacagggcaaacgagcagtacttc

SEQ ID NO: 449 - DNA, 39 bp, Homo sapiens
tgtgccagcggcgggacagggggatatggctacaccttc

SEQ ID NO: 450 - DNA, 48 bp, Homo sapiens
tgtgccagcggcagccccgggactagcggcggaaatgagcagttcttc

SEQ ID NO: 451 - DNA, 45 bp, Homo sapiens
tgtgccagcatcgaccggacagggcccggggagacccagtacttc

SEQ ID NO: 452 - DNA, 45 bp, Homo sapiens
tgtgccagcatcggactagcgggaggtatagatacgcagtatttt

SEQ ID NO: 453 - DNA, 39 bp, Homo sapiens
tgtgccagcaagggaccaggggcagaggcccattacttc

SEQ ID NO: 454 - DNA, 39 bp, Homo sapiens
tgtgccagcaagggaccaggggcagaggcccagtacttc

SEQ ID NO: 455 - DNA, 45 bp, Homo sapiens
tgtgccagcaaactcggacaggttccgggtcagccccagcatttt

SEQ ID NO: 456 - DNA, 42 bp, Homo sapiens
tgtgccagcaaattaacgacagccacctacgagcagtacttc

SEQ ID NO: 457 - DNA, 45 bp, Homo sapiens
tgtgccagcaaatcttatcgcgggaacaccggggagctgtttttt

SEQ ID NO: 458 - DNA, 42 bp, Homo sapiens
tgtgccagcaagtacagggggcctacctacgagcagtacttc

SEQ ID NO: 459 - DNA, 39 bp, Homo sapiens
tgtgccagcctgcaggggaacacctacgagcagtacttc

SEQ ID NO: 460 - DNA, 42 bp, Homo sapiens
tgtgccagcttgagttaccgggactacggggagctgtttttt

SEQ ID NO: 461 - DNA, 48 bp, Homo sapiens
tgtgccagcatgtcggggcctttgagctacaccggggagctgtttttt

SEQ ID NO: 462 - DNA, 48 bp, Homo sapiens
tgtgccagcatgtccgggcctatgacctacaccttcgagctgtgtttt

SEQ ID NO: 463 - DNA, 45 bp, Homo sapiens
tgtgccagcaatccgctggggggaggagtggagacccagtacttc

SEQ ID NO: 464 - DNA, 42 bp, Homo sapiens
tgtgccagcagagcgacagggggtcggcagccccagcatttt

SEQ ID NO: 465 - DNA, 45 bp, Homo sapiens
tgtgccagcagagaggggggccaaccgctcgatacgcagtatttt

SEQ ID NO: 466 - DNA, 36 bp, Homo sapiens
tgtgccagcaggggcggaatctatggctacaccttc

SEQ ID NO: 467 - DNA, 30 bp, Homo sapiens
tgtgccagcagactagagacccagtacttc

SEQ ID NO: 468 - DNA, 42 bp, Homo sapiens
tgtgccagcagattactagctgggtacaatgaccagttcttc

SEQ ID NO: 469 - DNA, 39 bp, Homo sapiens
tgtgccagcagacccgacgagagggatacgcagtatttt

SEQ ID NO: 470 - DNA, 42 bp, Homo sapiens
tgtgccagcagaccaggggcccccttgaacattcagtacttc

SEQ ID NO: 471 - DNA, 51 bp, Homo sapiens
tgtgccagcagacaagcgttagcgggagggcttaccgatgagcagttcttc

SEQ ID NO: 472 - DNA, 39 bp, Homo sapiens
tgtgccagccggagggacccctacaatgagcagttcttc

SEQ ID NO: 473 - DNA, 42 bp, Homo sapiens
tgtgccagcaggaggatcgagggcaccggggagctgtttttt

SEQ ID NO: 474 - DNA, 39 bp, Homo sapiens
tgtgcaagcaggtcgagggcgtcctacgagcagtacttc

SEQ ID NO: 475 - DNA, 48 bp, Homo sapiens
tgtgccagcaggagtactagcgggagctcctacaatgagcagttcttc

SEQ ID NO: 476 - DNA, 45 bp, Homo sapiens
tgtgccagcagaaccctcgggacagggtcagatacgcagtatttt

SEQ ID NO: 477 - DNA, 48 bp, Homo sapiens
tgtgccagcagagttaagagaggactagcagaagatacgcagtatttt

SEQ ID NO: 478 - DNA, 42 bp, Homo sapiens
tgtgccagcagggtaaaccgggctgagtatggctacaccttc

SEQ ID NO: 479 - DNA, 39 bp, Homo sapiens
tgtgccagctcagcggacagggaatacgagcagtacttc

SEQ ID NO: 480 - DNA, 42 bp, Homo sapiens
tgtgccagcagtgccctcgagaggtacaatgagcagttcttc

SEQ ID NO: 481 - DNA, 33 bp, Homo sapiens
tgtgccagcagtgccagggacgagcagtacttc

SEQ ID NO: 482 - DNA, 42 bp, Homo sapiens
tgtgccagcagtgcccgggacggagcctacgagcagtacttc

SEQ ID NO: 483 - DNA, 42 bp, Homo sapiens
  modified_base (24)..(24): a, c, t or g
tgtgccagcagttgcacggggctnagagatacccagtatttt

SEQ ID NO: 484 - DNA, 42 bp, Homo sapiens
tgtgccagcagtgacgcggaaagcgccgaccagcactacttc

SEQ ID NO: 485 - DNA, 42 bp, Homo sapiens
tgtgccagcagtgacgaggacagcgccgaccagcactacttc

SEQ ID NO: 486 - DNA, 42 bp, Homo sapiens
tgtgccagcagtgacgaggaaagcgccgaccagcagtacttt

SEQ ID NO: 487 - DNA, 45 bp, Homo sapiens
tgtgccagcagtgatttcgggggaggggccaacgtcctgactttc

SEQ ID NO: 488 - DNA, 42 bp, Homo sapiens
tgtgccagcagtgacggggacaggacctaccaccagtacttc

SEQ ID NO: 489 - DNA, 48 bp, Homo sapiens
tgtgccagcagtgatggagggtgggggtcctacaatgagcagttcttc

SEQ ID NO: 490 - DNA, 36 bp, Homo sapiens
tgtgccagcagtgacctctttgaaaaactgtttttt

SEQ ID NO: 491 - DNA, 45 bp, Homo sapiens
tgtgccagcagcgacccccccgcagggttcgacattcagtacttc

SEQ ID NO: 492 - DNA, 51 bp, Homo sapiens
tgtgccagcagtgacaggggccctatctctggggccaacgtcctgactttc

SEQ ID NO: 493 - DNA, 36 bp, Homo sapiens
tgtgccagcagtgatagcgccaatgagcagttcttc

SEQ ID NO: 494 - DNA, 45 bp, Homo sapiens
tgtgccagcagtgactctagcccaaacaccggggagctgtttttt

SEQ ID NO: 495 - DNA, 39 bp, Homo sapiens
tgtgccagcagtgatacagagaacactgaagatttcttt

SEQ ID NO: 496 - DNA, 40 bp, Homo sapiens
tgtgccagcagtgaggctgagggggcttcctacgagcagt

SEQ ID NO: 497 - DNA, 51 bp, Homo sapiens
tgtgccagcagtgaagccttcggtggtgccctgggacagccccagcatttt

SEQ ID NO: 498 - DNA, 36 bp, Homo sapiens
tgtgccagcagtgaagcgggcgtggagctgtttttt

SEQ ID NO: 499 - DNA, 48 bp, Homo sapiens
tgtgccagcagtgaagcgcaggggggccccacagatacgcagtatttt

SEQ ID NO: 500 - DNA, 48 bp, Homo sapiens
tgtgccagcagtgaagcgcaggggggccgcaccgatacgcagtttttt

SEQ ID NO: 501 - DNA, 51 bp, Homo sapiens
tgtgccagcagtgaagcccgggaccgtctggcggtctatggctacaccttc

SEQ ID NO: 502 - DNA, 45 bp, Homo sapiens
tgtgccagcagtgaagctagcgggagctcctacgagcagtacttc

SEQ ID NO: 503 - DNA, 48 bp, Homo sapiens
tgtgccagcagtgaagatcccccgggactagcggccgagcagtacttc

SEQ ID NO: 504 - DNA, 51 bp, Homo sapiens
tgtgccagcagtgaagatagtctagcggggcagaacaatgagcagttcttc

SEQ ID NO: 505 - DNA, 48 bp, Homo sapiens
tgtgccagcagtgaagataccgggacaggatcctacgagcagtacttc

SEQ ID NO: 506 - DNA, 48 bp, Homo sapiens
tgtgccagcagtgaagagagggacagggggcaggacgagtactacttc

SEQ ID NO: 507 - DNA, 48 bp, Homo sapiens
tgtgccagcagtgaagaggtcaaccctggggccaacgtcctgactttc

SEQ ID NO: 508 - DNA, 48 bp, Homo sapiens
tgtgccagcagtgaattttcgtcggggggcaagcatggctacaccttc

SEQ ID NO: 509 - DNA, 48 bp, Homo sapiens
tgtgccagcagtgaaggagacagctctggggccaacgtcctgactttc

SEQ ID NO: 510 - DNA, 42 bp, Homo sapiens
tgtgccagcagtgagggggacagcccctacgagcagtacttc

SEQ ID NO: 511 - DNA, 60 bp, Homo sapiens
tgtgccagcagtgaggggggggctagtcaagtgtcgggggtcaaaaacattcagtacttc

SEQ ID NO: 512 - DNA, 45 bp, Homo sapiens
tgtgccagcagtgaagggcaggtgtcccaagagacccagtacttc

SEQ ID NO: 513 - DNA, 45 bp, Homo sapiens
tgtgccagcagtgaactagcgggagacacagatacgcagtatttt

SEQ ID NO: 514 - DNA, 48 bp, Homo sapiens
tgtgccagcagtgaactagcgggagggccccaagagacccagtacttc

SEQ ID NO: 515 - DNA, 51 bp, Homo sapiens
tgtgccagcagtgaactaggacgcttctctggggccaacgtcctgactttc

SEQ ID NO: 516 - DNA, 45 bp, Homo sapiens
tgtgccagcagtgaacgggccggaggatcggagacccagtacttc

SEQ ID NO: 517 - DNA, 42 bp, Homo sapiens
tgtgccagcagtgagcgagggcccaatcagccccagcatttt

SEQ ID NO: 518 - DNA, 45 bp, Homo sapiens
tgtgccagcagtgaaaggacaggtgggaacactgaagctttcttt

SEQ ID NO: 519 - DNA, 39 bp, Homo sapiens
tgtgccagcagtgaaacagacaacactgaagctttcttt

SEQ ID NO: 520 - DNA, 42 bp, Homo sapiens
tgtgccagcagtgaaacggacaggggtcacgagcagtacttc

SEQ ID NO: 521 - DNA, 42 bp, Homo sapiens
tgtgccagcagtgagacgggagggtatggcgagcagtacttc

SEQ ID NO: 522 - DNA, 38 bp, Homo sapiens
tgtgccagcagtgagaccatctcctacgagcagtactt

SEQ ID NO: 523 - DNA, 42 bp, Homo sapiens
tgtgccagcagtgagactagcgggagggagactgacttcttc

SEQ ID NO: 524 - DNA, 45 bp, Homo sapiens
tgtgccagcagtgaagtatcgggtagtggaaacaccatatatttt

SEQ ID NO: 525 - DNA, 45 bp, Homo sapiens
tgtgccagcagctttctaacagacttccaagagacccagtacttc

SEQ ID NO: 526 - DNA, 42 bp, Homo sapiens
tgtgccagcagttttcccggtgtagtagagacccagtacttc

SEQ ID NO: 527 - DNA, 45 bp, Homo sapiens
tgtgccagcagtggggagcgggaggggaggtacgagcagtacttc

SEQ ID NO: 528 - DNA, 42 bp, Homo sapiens
tgtgccagcagtggactagcggattacaatgagcagttcttc

SEQ ID NO: 529 - DNA, 42 bp, Homo sapiens
tgtgccagcagtggacagcccatgaacactgaagctttcttt

SEQ ID NO: 530 - DNA, 45 bp, Homo sapiens
tgtgccagcagtggccgggacacagctgcctacgagcagtacttc

SEQ ID NO: 531 - DNA, 39 bp, Homo sapiens
tgtgccagcagtggtacagagaacactgaagctttcttt

SEQ ID NO: 532 - DNA, 45 bp, Homo sapiens
tgtgccagcagccacgctcatgagggagcggatacgcagtatttt

SEQ ID NO: 533 - DNA, 45 bp, Homo sapiens
tgtgccagcagtcacctcggggacggaacagatacgcagtatttt

SEQ ID NO: 534 - DNA, 39 bp, Homo sapiens
tgtgccagcagccataaccctaactatggctacaccttc

SEQ ID NO: 535 - DNA, 51 bp, Homo sapiens
tgtgccagcagccaccgggggcggggggacccccacactttcggttttttt

SEQ ID NO: 536 - DNA, 42 bp, Homo sapiens
tgtgccagcagtcactcaaggagcggggaccatttatccttc

SEQ ID NO: 537 - DNA, 42 bp, Homo sapiens
tgtgccagcagtattgactctcaagccggggagctgtttttt

SEQ ID NO: 538 - DNA, 45 bp, Homo sapiens
tgtgccagcagcattagcgggagccactcctacgagcagtacttc

SEQ ID NO: 539 - DNA, 42 bp, Homo sapiens
tgtgccagcagtatctcaaggatcggggacaatctgtacttc

SEQ ID NO: 540 - DNA, 42 bp, Homo sapiens
tgtgccagcagtatctcaaggaccggggacaatctgtacttc

SEQ ID NO: 541 - DNA, 45 bp, Homo sapiens
tgtgccagcagtaagggggcaggggccgcctacggctacaccttc

SEQ ID NO: 542 - DNA, 45 bp, Homo sapiens
tgtgccagcagtaaataccctgggggcagaaacaccatatatttt

SEQ ID NO: 543 - DNA, 39 bp, Homo sapiens
tgtgccagcagcctagcgggagtttacgagcagtacttc

SEQ ID NO: 544 - DNA, 45 bp, Homo sapiens
tgtgccagcagtttgggactagcggggaacaatgagcagttcttc

SEQ ID NO: 545 - DNA, 42 bp, Homo sapiens
tgtgccagcagtttgggacagggggcaaacaccatatatttt

SEQ ID NO: 546 - DNA, 42 bp, Homo sapiens
tgtgccagcagcctgggacagcaccaagagacccagtacttc

SEQ ID NO: 547 - DNA, 42 bp, Homo sapiens
tgtgccagcagtctcgggactccccgggatgagcagttcttc

SEQ ID NO: 548 - DNA, 48 bp, Homo sapiens
tgtgccagcagtttaatccgacagggttggggctatggctacaccttc

SEQ ID NO: 549 - DNA, 45 bp, Homo sapiens
tgtgccagcagtttgctagcgggagaaaacgacgagcagtacttc

SEQ ID NO: 550 - DNA, 30 bp, Homo sapiens
tgtgccagcagtctcaggacccagcatttt

SEQ ID NO: 551 - DNA, 42 bp, Homo sapiens
tgtgccagcagtctctccgggaccggggacaatctgtccttc

SEQ ID NO: 552 - DNA, 39 bp, Homo sapiens
tgtgccagcagtctaagctcctacaatgagcagttcttc

SEQ ID NO: 553 - DNA, 42 bp, Homo sapiens
tgtgccagctccaacagggggccgaatcagccccagcatttt

SEQ ID NO: 554 - DNA, 42 bp, Homo sapiens
tgtgccagcagtccagcgggagaggggtacgagcagtacttc

SEQ ID NO: 555 - DNA, 39 bp, Homo sapiens
tgtgccagcagtccagacagagcagagacccagtacttc

SEQ ID NO: 556 - DNA, 48 bp, Homo sapiens
tgtgccagcagcccggagtccgtccgaggaggaaacaccatatatttt

SEQ ID NO: 557 - DNA, 36 bp, Homo sapiens
tgtgccagcagtcctggggccaacgtcctgactttc

SEQ ID NO: 558 - DNA, 42 bp, Homo sapiens
tgtgccagcagtcccggggggggggacgactatcagtacttc

SEQ ID NO: 559 - DNA, 36 bp, Homo sapiens
tgtgccagcagccccggggggggaaaactgtttttt

SEQ ID NO: 560 - DNA, 42 bp, Homo sapiens
tgtgccagcagtcccgggggggggaacgaccaccagtacttc

SEQ ID NO: 561 - DNA, 42 bp, Homo sapiens
tgtgccagcagtcccgggggggggaactaccagcagtacttc

SEQ ID NO: 562 - DNA, 45 bp, Homo sapiens
tgtgccagcagccccgggccggggccggggaatgagcagttcttc

SEQ ID NO: 563 - DNA, 45 bp, Homo sapiens
tgtgccagcagtccgggacagggggggatcaatgagcagttcttc

SEQ ID NO: 564 - DNA, 42 bp, Homo sapiens
tgtgccagcagtccgggacagggcaactacgagcagtacttc

SEQ ID NO: 565 - DNA, 42 bp, Homo sapiens
tgtgccagcagtccgggacagggcaactacaagcagtacttc

SEQ ID NO: 566 - DNA, 45 bp, Homo sapiens
tgtgccagcagtccagggacagggatctacaatgagcagttcttc

SEQ ID NO: 567 - DNA, 48 bp, Homo sapiens
tgtgccagcagtccaatagcgggagggcctggggatacgcagtatttt

SEQ ID NO: 568 - DNA, 48 bp, Homo sapiens
tgtgccagcagcccgattaacagggggcaccaagagacccagtacttc

SEQ ID NO: 569 - DNA, 48 bp, Homo sapiens
tgtgccagcagtcccaaggcggcggggatcaatgaaaaactgtttttt

SEQ ID NO: 570 - DNA, 45 bp, Homo sapiens
tgtgccagcagcccactagcggaaccgacagatacgcagtatttt

SEQ ID NO: 571 - DNA, 48 bp, Homo sapiens
tgtgccagcagtcccctgagcgggaggcacgcggatacgcagtatttt

SEQ ID NO: 572 - DNA, 45 bp, Homo sapiens
tgtgccagcagtcctccgggacctaagatagatacgcagtatttt

SEQ ID NO: 573 - DNA, 42 bp, Homo sapiens
tgtgccagcagtccctcagggctcctcgcgccccagcatttt

SEQ ID NO: 574 - DNA, 45 bp, Homo sapiens
tgtgccagcagcccctcgacagggagtctgggcgagcagtacttc

SEQ ID NO: 575 - DNA, 45 bp, Homo sapiens
tgtgccagcagtcctaccgggacaggggcgggagagcagtacttc

SEQ ID NO: 576 - DNA, 48 bp, Homo sapiens
tgtgccagcagtcaaggacaggggaggttgacagatacgcagtatttt

SEQ ID NO: 577 - DNA, 45 bp, Homo sapiens
tgtgccagcagccaaaaacccgggccctgggaagtggagaccttc

SEQ ID NO: 578 - DNA, 45 bp, Homo sapiens
tgtgccagcagccgattggagggactctacaatgagcagttcttc

SEQ ID NO: 579 - DNA, 39 bp, Homo sapiens
tgtgccagcagccggactagtatccatgagcagttcttc

SEQ ID NO: 580 - DNA, 36 bp, Homo sapiens
tgtgccagcagccgtactagtgtgagggccctcttc

SEQ ID NO: 581 - DNA, 33 bp, Homo sapiens
tgtgccagcagctccgcatgggagcagtacttc

SEQ ID NO: 582 - DNA, 42 bp, Homo sapiens
tgtgccagcagttccgaacgggccaggtgccaacaatacttc

SEQ ID NO: 583 - DNA, 39 bp, Homo sapiens
tgtgccagcagttccggggcaacctacgagcagtacttc

SEQ ID NO: 584 - DNA, 39 bp, Homo sapiens
tgtgccagcagttccgggggaacctacgagcagtacttc

SEQ ID NO: 585 - DNA, 42 bp, Homo sapiens
tgtgccagcagttcaggacacatgaacactgaagctttcttt

SEQ ID NO: 586 - DNA, 42 bp, Homo sapiens
tgtgccagcagttcgggactaggtttcaatgagcagttcttc

SEQ ID NO: 587 - DNA, 48 bp, Homo sapiens
tgtgccagcagctcaggacagggaggatcctacaatgatcagttcttc

SEQ ID NO: 588 - DNA, 45 bp, Homo sapiens
tgtgccagcagctccgggacaggggcgggagagacccagtacttc

SEQ ID NO: 589 - DNA, 51 bp, Homo sapiens
tgtgccagcagttccgggactagcggggatttttacaatgagcagttcttc

SEQ ID NO: 590 - DNA, 42 bp, Homo sapiens
tgtgccagcagttccctccctctggcagatacgcagtatttt

SEQ ID NO: 591 - DNA, 57 bp, Homo sapiens
tgtgccagcagttctctctccgggactagcgggaaaacagggtacgagcagtacttc

SEQ ID NO: 592 - DNA, 42 bp, Homo sapiens
tgtgccagcagttcctcggtgaatggaaacaccatatatttt

SEQ ID NO: 593 - DNA, 39 bp, Homo sapiens
tgtgccagcagctcaacaggggacactgaagctttcttt

SEQ ID NO: 594 - DNA, 39 bp, Homo sapiens
tgtgccagcagtacagggttccgagatacgcagtatttt

SEQ ID NO: 595 - DNA, 39 bp, Homo sapiens
tgtgccagcagtactacagggggaaagggctacaccttc

SEQ ID NO: 596 - DNA, 51 bp, Homo sapiens
tgtgccagcagtgtcaaggggctagttagggagtacaatgagcagttcttc

SEQ ID NO: 597 - DNA, 42 bp, Homo sapiens
tgtgccagcagtgtcccgggactagcgggagagcagttcttc

SEQ ID NO: 598 - DNA, 42 bp, Homo sapiens
tgtgccagcagtgtacaaaactcctacaatgagcagttcttc

SEQ ID NO: 599 - DNA, 39 bp, Homo sapiens
tgtgccagcagtgtgagggagaacactgaagctttcttt

SEQ ID NO: 600 - DNA, 42 bp, Homo sapiens
tgtgccagcagttgggccgggactacgaatgagcagttcttc

SEQ ID NO: 601 - DNA, 39 bp, Homo sapiens
tgtgccagcagttgggggatgggagagacccagtacttc

SEQ ID NO: 602 - DNA, 42 bp, Homo sapiens
tgtgccagcagttggaggactagcggttacgagcagtacttc

SEQ ID NO: 603 - DNA, 42 bp, Homo sapiens
tgtgccagcagttggacagggcttacagatacgcagtatttt

SEQ ID NO: 604 - DNA, 45 bp, Homo sapiens
tgtgccagcagttacgccgacagggaagtacagccccagcatttt

SEQ ID NO: 605 - DNA, 48 bp, Homo sapiens
tgtgccagcagttacgcggacactttctcctacaatgagcagttcttc

SEQ ID NO: 606 - DNA, 36 bp, Homo sapiens
tgtgccagcagttacgcaggggctgagcagttcttc

SEQ ID NO: 607 - DNA, 45 bp, Homo sapiens
tgtgccagcagttacgcgacaggggaggggtcacccctccacttt

SEQ ID NO: 608 - DNA, 51 bp, Homo sapiens
tgtgccagcagttacgcctacagggagacaactaatgaaaaactgtttttt

SEQ ID NO: 609 - DNA, 42 bp, Homo sapiens
tgtgccagcagttactttgagatggaagagacccagtacttc

SEQ ID NO: 610 - DNA, 39 bp, Homo sapiens
tgtgccagcagttatttcctgaacactgaagctttcttt

SEQ ID NO: 611 - DNA, 54 bp, Homo sapiens
tgtgccagcagttacttctcccccggactagcgggagaagagacccagtacttc

SEQ ID NO: 612 - DNA, 42 bp, Homo sapiens
tgtgccagcagttacggggcggggggatacgagcagtacttc

SEQ ID NO: 613 - DNA, 48 bp, Homo sapiens
tgtgccagcagttacggggccccaccccagtacaatgagcagttcttc

SEQ ID NO: 614 - DNA, 45 bp, Homo sapiens
tgtgccagcagttacggggctagcggttcagatacctactatttt

SEQ ID NO: 615 - DNA, 42 bp, Homo sapiens
tgtgccagcagttacggggactactcctacgagcagtacttc

SEQ ID NO: 616 - DNA, 42 bp, Homo sapiens
tgtgccagcagttacggggactactcctaccagcagtacttc

SEQ ID NO: 617 - DNA, 48 bp, Homo sapiens
tgtgccagcagttacggactagcggtaaacaccggggagctgtttttt

SEQ ID NO: 618 - DNA, 45 bp, Homo sapiens
tgtgccagcagttacgggcaaacgattaactatggctacaccttc

SEQ ID NO: 619 - DNA, 48 bp, Homo sapiens
tgtgccagcagttacggccgcgcgcgggagcccctatggtggtacttc

SEQ ID NO: 620 - DNA, 42 bp, Homo sapiens
tgtgccagcagttacggcaggagtaactatggctacaccttc

SEQ ID NO: 621 - DNA, 39 bp, Homo sapiens
tgtgccagcagttacggacgggtcaatgagcagttcttc

SEQ ID NO: 622 - DNA, 39 bp, Homo sapiens
tgtgccagcagttacggcagcacctacgagcagtacttc

SEQ ID NO: 623 - DNA, 48 bp, Homo sapiens
tgtgccagcagttacgggacaggggaagtcaccggggagctgtttttt

SEQ ID NO: 624 - DNA, 48 bp, Homo sapiens
tgtgccagcagttacggtacagggacgattcattcacccctccacttt

SEQ ID NO: 625 - DNA, 45 bp, Homo sapiens
tgtgccagcagttacgggaccagcgcctcccatacgcactttttt

SEQ ID NO: 626 - DNA, 45 bp, Homo sapiens
tgtgccagcagttacgggactagcggttcagatacgcagtatttt

SEQ ID NO: 627 - DNA, 36 bp, Homo sapiens
tgtgccagcagttacggcgtctacgagcagtacttc

SEQ ID NO: 628 - DNA, 39 bp, Homo sapiens
tgtgccagcagttacatacagaattcacccctccacttt

SEQ ID NO: 629 - DNA, 45 bp, Homo sapiens
tgtgccagcagttatctagcgggaaacacagatacgcagtatttt

SEQ ID NO: 630 - DNA, 45 bp, Homo sapiens
tgtgccagcagttacctcggggggtcgaacactgaagctttcttt

SEQ ID NO: 631 - DNA, 39 bp, Homo sapiens
tgtgccagcagttacttgggacagggagagcagtacttc

SEQ ID NO: 632 - DNA, 54 bp, Homo sapiens
tgtgccagcagttacctgactctagcgggagggccccaagagacccagtacttc

SEQ ID NO: 633 - DNA, 51 bp, Homo sapiens
tgtgccagcagttacaacccgacatcaggagccaaaaacattcagtacttc

SEQ ID NO: 634 - DNA, 51 bp, Homo sapiens
tgtgccagcagttaccccggacagggggcccacaccggggagctgtttttt

SEQ ID NO: 635 - DNA, 42 bp, Homo sapiens
tgtgccagcagttaccaggacagggggtacgagcagtacttc

SEQ ID NO: 636 - DNA, 48 bp, Homo sapiens
tgtgccagcagttaccaggggtgggggcccaatcagccccagcatttt

SEQ ID NO: 637 - DNA, 24 bp, Homo sapiens
tgtgccagcagttacagggatgag

SEQ ID NO: 638 - DNA, 42 bp, Homo sapiens
tgtgccagcagttatagggacctcccctaccaacaatacttc

SEQ ID NO: 639 - DNA, 45 bp, Homo sapiens
tgtgccagcagttatcgggactcgtactacaatgagcagttcttc

SEQ ID NO: 640 - DNA, 42 bp, Homo sapiens
tgtgccagcagttatagggacgtcgcctacgagcagtacttc

SEQ ID NO: 641 - DNA, 42 bp, Homo sapiens
tgtgccagcagttatagggacgtcccctacgagcagtacttc

SEQ ID NO: 642 - DNA, 42 bp, Homo sapiens
tgtgccagcagttatagggacgtcccctaccaacagtacttc

SEQ ID NO: 643 - DNA, 42 bp, Homo sapiens
tgtgccagcagttaccgtggacaggggaacgagcagtacttc

SEQ ID NO: 644 - DNA, 45 bp, Homo sapiens
tgtgccagcagttaccgcggcagggttttggacgagcagtacttc

SEQ ID NO: 645 - DNA, 45 bp, Homo sapiens
tgtgccagcagttaccgacaagatagcaatcagccccagcatttt

SEQ ID NO: 646 - DNA, 42 bp, Homo sapiens
tgtgccagcagttaccgacaggggacctacgagcagtacttc

SEQ ID NO: 647 - DNA, 51 bp, Homo sapiens
tgtgccagcagttaccgccaatacacatccgacggttacgagcagtacttc

SEQ ID NO: 648 - DNA, 42 bp, Homo sapiens
tgtgccagcagttaccggtggggtgtggatacccagtatttt

SEQ ID NO: 649 - DNA, 36 bp, Homo sapiens
tgtgccagcagttactcggcgggggagcagttcttc

SEQ ID NO: 650 - DNA, 36 bp, Homo sapiens
tgtgccagcagttactcggacgagacccagtacttc

SEQ ID NO: 651 - DNA, 48 bp, Homo sapiens
tgtgccagcagttactctggggacagtcaggtatcacccctccacttt

SEQ ID NO: 652 - DNA, 54 bp, Homo sapiens
tgtgccagcagttactcgggcggagagcgggagggccgggatgagcagttcttc

SEQ ID NO: 653 - DNA, 45 bp, Homo sapiens
tgtgccagcagttactcgggaggaaatggaaacaccatatatttt

SEQ ID NO: 654 - DNA, 42 bp, Homo sapiens
tgtgccagcagttactctgggcccctttacgagcagtacttc

SEQ ID NO: 655 - DNA, 42 bp, Homo sapiens
tgtgccagcagttactcagggaggggctatgattactccttc

SEQ ID NO: 656 - DNA, 48 bp, Homo sapiens
tgtgccagcagttactcgggccgacggcccctggacgagcagtacttc

SEQ ID NO: 657 - DNA, 51 bp, Homo sapiens
tgtgccagcagttactcgaaggcaggggggagaggaaacaccatatatttt

SEQ ID NO: 658 - DNA, 45 bp, Homo sapiens
tgtgccagcagttactccttagggggaagcactgaagctttcttt

SEQ ID NO: 659 - DNA, 42 bp, Homo sapiens
tgtgccagcagttactcgccagacacagatacgcagtatttt

SEQ ID NO: 660 - DNA, 48 bp, Homo sapiens
tgtgccagcagttactccccgactagcggcccctgggagcagtacttc

SEQ ID NO: 661 - DNA, 42 bp, Homo sapiens
tgtgccagcagttactctcagggggagaatgagcagttcttc

SEQ ID NO: 662 - DNA, 45 bp, Homo sapiens
tgtgccagcagttactctcagctagctaactatggctacaccttc

SEQ ID NO: 663 - DNA, 48 bp, Homo sapiens
tgtgccagcagttactcccaacgggacgatccctacgagcagtacttc

SEQ ID NO: 664 - DNA, 51 bp, Homo sapiens
tgtgccagcagttactcgagagacaggccctcctacaatgagcagttcttc

SEQ ID NO: 665 - DNA, 45 bp, Homo sapiens
tgtgccagcagttactctcgtgaaaacaccggggagctgtttttt

SEQ ID NO: 666 - DNA, 45 bp, Homo sapiens
tgtgccagcagttactcaaggcagggtgaaaacattcagtacttc

SEQ ID NO: 667 - DNA, 45 bp, Homo sapiens
tgtgccagcagttactcgagacagggtgggcagccccagcatttt

SEQ ID NO: 668 - DNA, 48 bp, Homo sapiens
tgtgccagcagttattctcgagtagcgggattcaatgagcagttcttc

SEQ ID NO: 669 - DNA, 39 bp, Homo sapiens
tgtgccagcagttactctcgctacaatgagcagttcttc

SEQ ID NO: 670 - DNA, 39 bp, Homo sapiens
tgtgccagcagttactcgtcgggcactgaagctttcttt

SEQ ID NO: 671 - DNA, 48 bp, Homo sapiens
tgtgccagcagttactcttctagcgatagctcctacgagcagtacttc

SEQ ID NO: 672 - DNA, 54 bp, Homo sapiens
tgtgccagcagttactcctcggttccgacagggttatcctatggctacaccttc

SEQ ID NO: 673 - DNA, 42 bp, Homo sapiens
tgtgccagcagttactcgacagagtctcgcgagcagtacttc

SEQ ID NO: 674 - DNA, 45 bp, Homo sapiens
tgtgccagcagttactcggtagggacagagtcacccctccacttt

SEQ ID NO: 675 - DNA, 42 bp, Homo sapiens
tgtgccagcagttactcggtcagcaatcagccccagcatttt

SEQ ID NO: 676 - DNA, 54 bp, Homo sapiens
tgtgccagcagttacactccacagagtagcgggaggtccggtgagcagttcttc

SEQ ID NO: 677 - DNA, 39 bp, Homo sapiens
tgtgccagcagttacgtagggggcactgaagctttcttt

SEQ ID NO: 678 - DNA, 42 bp, Homo sapiens
tgtgccagcagttacgtaactacaaaagagacccagtacttc

SEQ ID NO: 679 - DNA, 42 bp, Homo sapiens
tgtgccagcagttactgggagggggcttacgagcagtacttc

SEQ ID NO: 680 - DNA, 45 bp, Homo sapiens
tgtgccagcagttactatgggagggaaaccggggagctgtttttt

SEQ ID NO: 681 - DNA, 39 bp, Homo sapiens
tgtgccagcacggcgggaacctacaatgagcagttcttc

SEQ ID NO: 682 - DNA, 45 bp, Homo sapiens
tgtgccagcactgatttttacggcgggaggcatggctacaccttc

SEQ ID NO: 683 - DNA, 48 bp, Homo sapiens
tgtgccagcaccgatcctttgacaggcatgaacactgaagctttcttt

SEQ ID NO: 684 - DNA, 39 bp, Homo sapiens
tgtgccagcaccgaggacccgagggagccccagcatttt

SEQ ID NO: 685 - DNA, 51 bp, Homo sapiens
tgtgccagcacccaccggggaaagggggattctgacactttaggtttcttt

SEQ ID NO: 686 - DNA, 36 bp, Homo sapiens
tgtgccagcaccctgacaggttatggctacaccttc

SEQ ID NO: 687 - DNA, 48 bp, Homo sapiens
tgtgccagcaccatgctagcgggagttgaaaccggggagctgtttttt

SEQ ID NO: 688 - DNA, 42 bp, Homo sapiens
tgtgccagcacccctctggggactagcggcgagcagttcttc

SEQ ID NO: 689 - DNA, 42 bp, Homo sapiens
tgtgccagcaccccacgggagcgcccctccgagcagtacttc

SEQ ID NO: 690 - DNA, 45 bp, Homo sapiens
tgtgccagcaccccgtccggggcctggcaagagacccagtacttc

SEQ ID NO: 691 - DNA, 36 bp, Homo sapiens
tgtgccagcacccagggtggggccgagctgtttttt

SEQ ID NO: 692 - DNA, 42 bp, Homo sapiens
tgtgccagcacacgggactctagcacagatacgcagtatttt

SEQ ID NO: 693 - DNA, 51 bp, Homo sapiens
tgtgccagcacccgtccgggacagggggcttctgacactgaagctttcttt

SEQ ID NO: 694 - DNA, 36 bp, Homo sapiens
tgtgccagcacttccggcctccgggagctgtttttt

SEQ ID NO: 695 - DNA, 39 bp, Homo sapiens
tgtgccagcaccacggggttgaacactgaagctttcttt

SEQ ID NO: 696 - DNA, 42 bp, Homo sapiens
tgtgccagcaccgtgggacagggggcgtgggagcagtacttc

SEQ ID NO: 697 - DNA, 42 bp, Homo sapiens
tgtgccagctgggacgccctggacccagatacgcagtatttt

SEQ ID NO: 698 - DNA, 42 bp, Homo sapiens
tgtgccactgaggggcgtttggtgaacactgaagctttcttt

SEQ ID NO: 699 - DNA, 45 bp, Homo sapiens
tgtgccatcagcatatccgccgggagcccagatacccaatatttt

SEQ ID NO: 700 - DNA, 48 bp, Homo sapiens
tgtgccccaaggaaccggacagggggagatctccacgagcagtacttc

SEQ ID NO: 701 - DNA, 39 bp, Homo sapiens
tgtgcctccggacggagctcctacaatgagcagttcttc

SEQ ID NO: 702 - DNA, 39 bp, Homo sapiens
tgtgccagcaggttcgagggcggagagacccagtacttc

SEQ ID NO: 703 - DNA, 42 bp, Homo sapiens
tgtgccagcagaggacaggggaacaccggggagctgtttttt

SEQ ID NO: 704 - DNA, 39 bp, Homo sapiens
tgtgccagcagaaccgggaactgggagacccagtacttc

SEQ ID NO: 705 - DNA, 39 bp, Homo sapiens
tgtgccagcagcgagggggcggcctacgagcagtacttc

SEQ ID NO: 706 - DNA, 45 bp, Homo sapiens
tgtgccagcagcttcctagcgggggttttgaatgagcagttcttc

SEQ ID NO: 707 - DNA, 45 bp, Homo sapiens
tgtgccagcagctttatggcgagctcctacaatgagcagttcttc

SEQ ID NO: 708 - DNA, 42 bp, Homo sapiens
tgtgccagcagcttcaacgggagaaccggggagctgtttttt

SEQ ID NO: 709 - DNA, 48 bp, Homo sapiens
tgtgccagcagcttccgacagggcagtgacaccggggagctgtttttt

SEQ ID NO: 710 - DNA, 39 bp, Homo sapiens
tgtgccagcagcggggtgttggttgatacgcagtatttt

SEQ ID NO: 711 - DNA, 39 bp, Homo sapiens
tgtgccagcagccacggggggtcagatacgcagtatttt

SEQ ID NO: 712 - DNA, 48 bp, Homo sapiens
tgtgccagcagccacatagcgggagggtcctacaatgagcagttcttc

SEQ ID NO: 713 - DNA, 39 bp, Homo sapiens
tgtgccagcagcttagcgggcgggcacggctacaccttc

SEQ ID NO: 714 - DNA, 42 bp, Homo sapiens
tgtgccagcagcttagcgctaggggggccagagcagtacttc

SEQ ID NO: 715 - DNA, 57 bp, Homo sapiens
tgtgccagcagcttagcgttgggactagcgggagggcccacagatacgcagtatttt

SEQ ID NO: 716 - DNA, 51 bp, Homo sapiens
tgtgccagcagcttagcctcggacagggcccccgagaatgagcagttcttc

SEQ ID NO: 717 - DNA, 42 bp, Homo sapiens
tgtgccagcagcttagacgggggaggagggggctacaccttc

SEQ ID NO: 718 - DNA, 45 bp, Homo sapiens
tgtgccagcagcttagacgggcgggatgtagatacgcagtatttt

SEQ ID NO: 719 - DNA, 39 bp, Homo sapiens
tgtgccagcagcttagatccgcaagagacccagtacttc

SEQ ID NO: 720 - DNA, 42 bp, Homo sapiens
tgtgccagcagcttagacagaaacaccggggagctgtttttt

SEQ ID NO: 721 - DNA, 51 bp, Homo sapiens
tgtgccagcagcttagaccggtgggatgggagcacagatacgcagtatttt

SEQ ID NO: 722 - DNA, 39 bp, Homo sapiens
tgtgccagcagcttagactggaatcagccccagcatttt

SEQ ID NO: 723 - DNA, 42 bp, Homo sapiens
tgtgccagcagcttagaggactcctacaatgagcagttcttc

SEQ ID NO: 724 - DNA, 45 bp, Homo sapiens
tgtgccagcagcttagaactaatcgttgaagagacccagtacttc

SEQ ID NO: 725 - DNA, 45 bp, Homo sapiens
tgtgccagcagcttagaactaagcgttgaagagacccagtacttc

SEQ ID NO: 726 - DNA, 45 bp, Homo sapiens
tgtgccagcagcttagaagtggcgttggactacgagcagtacttc

SEQ ID NO: 727 - DNA, 42 bp, Homo sapiens
tgtgccagcagcttatttgcgggagcagatacgcagtatttt

SEQ ID NO: 728 - DNA, 45 bp, Homo sapiens
tgtgccagcagcctcttccctagcgactacaatgagcagttcttc

SEQ ID NO: 729 - DNA, 39 bp, Homo sapiens
tgtgccagcagcttgggggggggtgaaaaactgtttttt

SEQ ID NO: 730 - DNA, 36 bp, Homo sapiens
tgtgccagcagcttaggggggaatgagcagttcttc

SEQ ID NO: 731 - DNA, 36 bp, Homo sapiens
tgtgccagcagccttgggggcactgaagctttcttt

SEQ ID NO: 732 - DNA, 42 bp, Homo sapiens
tgtgccagcagcttgggacagggggccaacgagcagtacttc

SEQ ID NO: 733 - DNA, 51 bp, Homo sapiens
tgtgccagcagcttagggcgtgagacaggggaagtctatggctacaccttc

SEQ ID NO: 734 - DNA, 39 bp, Homo sapiens
tgtgccagcagcttggggactagcgatgagcagttcttc

SEQ ID NO: 735 - DNA, 39 bp, Homo sapiens
tgtgccagcagcttagggtacgtcagcgagcagtacttc

SEQ ID NO: 736 - DNA, 48 bp, Homo sapiens
tgtgccagcagcttaattggggtttcggtctacaatgagcagttcttc

SEQ ID NO: 737 - DNA, 39 bp, Homo sapiens
tgtgccagcagcttaaaagtactgggagaagctttcttt

SEQ ID NO: 738 - DNA, 45 bp, Homo sapiens
tgtgccagcagcttactcgggggatacggaaacaccatatatttt

SEQ ID NO: 739 - DNA, 54 bp, Homo sapiens
tgtgccagcagcttgatggagtcgggattggtggggagagatacgcagtatttt

SEQ ID NO: 740 - DNA, 39 bp, Homo sapiens
tgtgccagcagcttaatgggcggacatgagcagttcttc

SEQ ID NO: 741 - DNA, 48 bp, Homo sapiens
tgtgccagcagcttaatgggggggacaggcaatgaaaaactgtttttt

SEQ ID NO: 742 - DNA, 48 bp, Homo sapiens
tgtgccagcagcttaaatccgggactagcggaagagacccagtacttc

SEQ ID NO: 743 - DNA, 54 bp, Homo sapiens
tgtgccagcagcttaaaccccctcgcccgcgggacagacaatgagcagttcttc

SEQ ID NO: 744 - DNA, 51 bp, Homo sapiens
tgtgccagcagcttaagaggttggactagcgacacagatacgcagtatttt

SEQ ID NO: 745 - DNA, 45 bp, Homo sapiens
tgtgccagcagcttaagtgcggctggggccaacgtcctgactttc

SEQ ID NO: 746 - DNA, 45 bp, Homo sapiens
tgtgccagcagcttatccgccgggagcccagatacgcagtatttt

SEQ ID NO: 747 - DNA, 45 bp, Homo sapiens
tgtgccagcagcttaagtagcgggagcattgatgagcagttcttc

SEQ ID NO: 748 - DNA, 45 bp, Homo sapiens
tgtgccagcagcctgacgggcgggagggcagatacgcagtatttt

SEQ ID NO: 749 - DNA, 45 bp, Homo sapiens
tgtgccagcagcttaacagggacaggagtgtacgagcagtacttc

SEQ ID NO: 750 - DNA, 48 bp, Homo sapiens
tgtgccagcagcttgactagcgggagctcctacaatgagcagttcttc

SEQ ID NO: 751 - DNA, 42 bp, Homo sapiens
tgtgccagcagcttagtagacggaacctacgagcagtacttc

SEQ ID NO: 752 - DNA, 60 bp, Homo sapiens
tgtgccagcagcttagttcctcctggactagcgggagtcgaaggatacgagcagtacttc

SEQ ID NO: 753 - DNA, 42 bp, Homo sapiens
tgtgccagcagcttagttcaggcccaagagacccagtacttc

SEQ ID NO: 754 - DNA, 54 bp, Homo sapiens
tgtgccagcagcttatgggagacagggaaatcgaccaccggggagctgtttttt

SEQ ID NO: 755 - DNA, 54 bp, Homo sapiens
tgtgccagcagcttatactttggtggactagcgggacccggggagctgtttttt

SEQ ID NO: 756 - DNA, 48 bp, Homo sapiens
tgtgccagcagcatgggactagcggagaccttatacgagcagtacttc

SEQ ID NO: 757 - DNA, 48 bp, Homo sapiens
tgtgccagcagccccgacccccatagggggatccacgagcagtacttc

SEQ ID NO: 758 - DNA, 36 bp, Homo sapiens
tgtgccagcagccccgactacaatgagcagttcttc

SEQ ID NO: 759 - DNA, 48 bp, Homo sapiens
tgtgccagcagccccgggactagcgggagggtcaatgagcagttcttc

SEQ ID NO: 760 - DNA, 48 bp, Homo sapiens
tgtgccagcagcccaattgggtctgagtctggaaacaccatatatttt

SEQ ID NO: 761 - DNA, 48 bp, Homo sapiens
tgtgccagcagcccccgggcagggggcgatatcaatgagcagttcttc

SEQ ID NO: 762 - DNA, 42 bp, Homo sapiens
tgtgccagcagccctcgggagaacaccggggagctgtttttt

SEQ ID NO: 763 - DNA, 36 bp, Homo sapiens
tgtgccagcagcccacgggggaacgagcagtacttc

SEQ ID NO: 764 - DNA, 36 bp, Homo sapiens
tgtgccagcagcccccggactagcgagtggttcttc

SEQ ID NO: 765 - DNA, 39 bp, Homo sapiens
tgtgccagcagcccaaggactaccggggagctgtttttt

SEQ ID NO: 766 - DNA, 45 bp, Homo sapiens
tgtgccagcagcccgacagggggcgcaggcggggagctgtttttt

SEQ ID NO: 767 - DNA, 48 bp, Homo sapiens
tgtgccagcagcccctacccgggacaaaactacaatgagcagttcttc

SEQ ID NO: 768 - DNA, 45 bp, Homo sapiens
tgtgccagcagcccgtataggtctaataacaatgagcagttcttc

SEQ ID NO: 769 - DNA, 45 bp, Homo sapiens
tgtgccagcagccagggtccccctggggccaacgtcctgactttc

SEQ ID NO: 770 - DNA, 42 bp, Homo sapiens
tgtgccagcagccgtgatctcccctcctacgagcagtacttc

SEQ ID NO: 771 - DNA, 39 bp, Homo sapiens
tgtgccagcagccgtcccggcacagatacgcagtatttt

SEQ ID NO: 772 - DNA, 57 bp, Homo sapiens
tgtgccagcagccggacctatacgtactccgggacagctaactatggctacaccttc

SEQ ID NO: 773 - DNA, 45 bp, Homo sapiens
tgtgccagcagcagatgggacagcagctcctacgagcagtacttc

SEQ ID NO: 774 - DNA, 45 bp, Homo sapiens
tgtgccagcagctccgaagcgggagcacaagagacccagtacttc

SEQ ID NO: 775 - DNA, 39 bp, Homo sapiens
tgtgccagcagctccgagatgaacactgaagctttcttt

SEQ ID NO: 776 - DNA, 42 bp, Homo sapiens
tgtgctagcagcagcgagatgaacaccggggagctgtttttt

SEQ ID NO: 777 - DNA, 54 bp, Homo sapiens
tgtgccagcagctctggactagcgggaggtgcgagctcctacgagcagtacttc

SEQ ID NO: 778 - DNA, 39 bp, Homo sapiens
tgtgccagcagctccgggtcctacaatgagcagttcttc

SEQ ID NO: 779 - DNA, 45 bp, Homo sapiens
tgtgccagcagctcaattagactagccgacaatgagcagttcttc

SEQ ID NO: 780 - DNA, 39 bp, Homo sapiens
tgtgccagcagctccctattatcctatggctacaccttc

SEQ ID NO: 781 - DNA, 42 bp, Homo sapiens
tgtgccagcagctcaaactgggatcactatggctacaccttc

SEQ ID NO: 782 - DNA, 48 bp, Homo sapiens
tgtgccagcagcagctccgggacagggtacaccggggagctgtttttt

SEQ ID NO: 783 - DNA, 45 bp, Homo sapiens
tgtgccagcagctccactagcgggggctcctacgagcagtacttc

SEQ ID NO: 784 - DNA, 39 bp, Homo sapiens
tgtgccagcagctcatacgacgcagatacgcagtatttt

SEQ ID NO: 785 - DNA, 45 bp, Homo sapiens
tgtgccagcagtaccgggactagcgattacaatgagcagttcttc

SEQ ID NO: 786 - DNA, 48 bp, Homo sapiens
tgtgccagcagctggggcggagcgggagggggctatgagcagttcttc

SEQ ID NO: 787 - DNA, 45 bp, Homo sapiens
tgtgccagcagctggggactgaactctggaaacaccatatatttt

SEQ ID NO: 788 - DNA, 45 bp, Homo sapiens
tgtgccagcagctaccctacagggtcctacaatgagcagttcttc

SEQ ID NO: 789 - DNA, 48 bp, Homo sapiens
tgtgccagcaccgaacttacgggaccccgggcaaacgagcagttcttc

SEQ ID NO: 790 - DNA, 42 bp, Homo sapiens
tgtgccagcaccttagcgggaggggtcaatgagcagttcttc

SEQ ID NO: 791 - DNA, 42 bp, Homo sapiens
tgtgccagcagcgccgggacggctaactatggctacaccttc

SEQ ID NO: 792 - DNA, 39 bp, Homo sapiens
tgtgccagcagcgcaggggtatcgcggggctacaccttc

SEQ ID NO: 793 - DNA, 51 bp, Homo sapiens
tgtgccagcagcgcccaccagggactagatcttggagatacgcagtatttt

SEQ ID NO: 794 - DNA, 48 bp, Homo sapiens
tgtgccagcagcgccctcaccgggaaccccacagatacgcagtatttt

SEQ ID NO: 795 - DNA, 45 bp, Homo sapiens
tgtgccagcagcgcttccgggacagcgaacactgaagctttcttt

SEQ ID NO: 796 - DNA, 45 bp, Homo sapiens
tgtgccagcagcgcctcacagggcgggggcactgaagctttcttt

SEQ ID NO: 797 - DNA, 45 bp, Homo sapiens
tgtgccagcagcgccaccgggactggaggcactgaagctttcttt

SEQ ID NO: 798 - DNA, 45 bp, Homo sapiens
tgtgccagcagcgcgactagcggcgacctctacgagcagtacttc

SEQ ID NO: 799 - DNA, 45 bp, Homo sapiens
tgtgccagcagcgccactaccgggacaatttacgagcagtacttc

SEQ ID NO: 800 - DNA, 42 bp, Homo sapiens
tgtgccagcagcgcatatggacagggcactgaagctttcttt

SEQ ID NO: 801 - DNA, 48 bp, Homo sapiens
tgtgccagcagcgcctatcctgaagggacaggccaagaccagtacttc

SEQ ID NO: 802 - DNA, 48 bp, Homo sapiens
tgtgccagcagcgacgggactagcggaagaggggatacgcagtatttt

SEQ ID NO: 803 - DNA, 45 bp, Homo sapiens
tgtgccagcagcgagcacggggctggggccaacgtcctgactttc

SEQ ID NO: 804 - DNA, 45 bp, Homo sapiens
tgtgccagcagcgaatccgggactaccacagatacgcagtatttt

SEQ ID NO: 805 - DNA, 45 bp, Homo sapiens
tgtgccagcagcgaatggacagctagcacagatacgcagtatttt

SEQ ID NO: 806 - DNA, 45 bp, Homo sapiens
tgtgccagcagcgagtacaggggagtgggggaaaaactgtttttt

SEQ ID NO: 807 - DNA, 51 bp, Homo sapiens
  modified_base (23)..(23): a, c, t or g
  modified_base (40)..(40): a, c, t or g
  modified_base (45)..(45): a, c, t or g
tgtgccagcagcttcggactagngggacccccagcctacnagcantacttc

SEQ ID NO: 808 - DNA, 42 bp, Homo sapiens
tgtgccagcagcggggattcaggggtaacagaactgtttttt

SEQ ID NO: 809 - DNA, 36 bp, Homo sapiens
tgtgccagcagcggagactcctacgagcagtacttc

SEQ ID NO: 810 - DNA, 42 bp, Homo sapiens
tgtgccagcagcggcgaagacagctcctacgagcagtacttc

SEQ ID NO: 811 - DNA, 45 bp, Homo sapiens
tgtgccagcagcgggggggagcggggtacctacgagcagtacttc

SEQ ID NO: 812 - DNA, 51 bp, Homo sapiens
tgtgccagcagcggacagggggttatctctggggccaacgtcctgactttc

SEQ ID NO: 813 - DNA, 42 bp, Homo sapiens
tgtgccagcagcggttctagcgggggtgagacccagtacttc

SEQ ID NO: 814 - DNA, 45 bp, Homo sapiens
tgtgccagcagcttagaaggggtatccacagatacgcagtatttt

SEQ ID NO: 815 - DNA, 45 bp, Homo sapiens
tgtgccagcagcttaggagcgggacaggaatcacccctccacttt

SEQ ID NO: 816 - DNA, 42 bp, Homo sapiens
tgtgccagcagcttaggggctagcacagatacgcagtatttt

SEQ ID NO: 817 - DNA, 45 bp, Homo sapiens
tgtgccagcagcctcggggacggattcaatcagccccagcatttt

SEQ ID NO: 818 - DNA, 51 bp, Homo sapiens
tgtgccagcagcttgggactagggggatccccagcctactaccagtacttc

SEQ ID NO: 819 - DNA, 45 bp, Homo sapiens
tgtgccagcagcctcgggacaaacagcaatcagccccagcatttt

SEQ ID NO: 820 - DNA, 45 bp, Homo sapiens
tgtgccagcagcctacaggggggctcctacaatgagcagttcttc

SEQ ID NO: 821 - DNA, 48 bp, Homo sapiens
tgtgccagcagcctccggggtagcggggtcgccggggagctgtttttt

SEQ ID NO: 822 - DNA, 42 bp, Homo sapiens
tgtgccagcagcccgggacagggctcctacgagcagtacttc

SEQ ID NO: 823 - DNA, 42 bp, Homo sapiens
tgtgccagcagcccccattggtctgttcagccccagcatttt

SEQ ID NO: 824 - DNA, 48 bp, Homo sapiens
tgtgccagcagcccccctgccggtccctcctacaatgagcagttcttc

SEQ ID NO: 825 - DNA, 45 bp, Homo sapiens
tgtgccagcagcccacaagcgagttcctacaatgagcagttcttc

SEQ ID NO: 826 - DNA, 45 bp, Homo sapiens
tgtgccagcagccccacggacagggcggatcagccccagcatttt

SEQ ID NO: 827 - DNA, 39 bp, Homo sapiens
tgtgccagcagccgcggaatgaacactgaagctttcttt

SEQ ID NO: 828 - DNA, 45 bp, Homo sapiens
tgtgccagcagtcgttggaccgctccccaagagacccagtacttc

SEQ ID NO: 829 - DNA, 48 bp, Homo sapiens
tgtgccagcagttctaaagcgggaggctcctacaatgagcagttcttc

SEQ ID NO: 830 - DNA, 45 bp, Homo sapiens
tgtgccagcagctcccgcgggagggggcaagagacccagtacttc

SEQ ID NO: 831 - DNA, 42 bp, Homo sapiens
tgtgccagcagcagtagcgggggcggaaatgagcagttcttc

SEQ ID NO: 832 - DNA, 39 bp, Homo sapiens
tgtgccagcagcgtagcagggtccggggagctgtttttt

SEQ ID NO: 833 - DNA, 42 bp, Homo sapiens
tgtgccagcagcgtagcttacaggggcggtgaagctttcttt

SEQ ID NO: 834 - DNA, 39 bp, Homo sapiens
tgtgccagcagcgtagatgaggggaccccctacaccttc

SEQ ID NO: 835 - DNA, 48 bp, Homo sapiens
tgtgccagcagcgtagatggggggcattcctcctacgagcagtacttc

SEQ ID NO: 836 - DNA, 45 bp, Homo sapiens
tgtgccagcagcgtagacgggaatagcaatcagccccagcatttt

SEQ ID NO: 837 - DNA, 45 bp, Homo sapiens
tgtgccagcagcgtagaccttgtggggaacaatgagcagttcttc

SEQ ID NO: 838 - DNA, 45 bp, Homo sapiens
tgtgccagcagcgtagacagcggggaatacaatgagcagttcttc

SEQ ID NO: 839 - DNA, 45 bp, Homo sapiens
tgtgccagcagcgtagaggctagcggctacaatgagcagttcttc

SEQ ID NO: 840 - DNA, 45 bp, Homo sapiens
tgtgccagcagcgtagagggcaggagcacagatacgcagtatttt

SEQ ID NO: 841 - DNA, 42 bp, Homo sapiens
tgtgccagcagcgtagagtatagggggaatgagcagttcttc

SEQ ID NO: 842 - DNA, 42 bp, Homo sapiens
tgtgccagcagcgtaggggcatttgacggtgagcagttcttc

SEQ ID NO: 843 - DNA, 45 bp, Homo sapiens
tgtgccagcagcgtaggggcgggagccaaaaacattcagtacttc

SEQ ID NO: 844 - DNA, 45 bp, Homo sapiens
tgtgccagcagcgtaggagcgggagggcccaatgagcagttcttc

SEQ ID NO: 845 - DNA, 36 bp, Homo sapiens
tgtgccagcagcgttgggggagagacccagtacttc

SEQ ID NO: 846 - DNA, 45 bp, Homo sapiens
tgtgccagcagcgtaggaggagggctggacaatgagcagttcttc

SEQ ID NO: 847 - DNA, 45 bp, Homo sapiens
tgtgccagcagcgtagggggcaggggcacagatacgcagtatttt

SEQ ID NO: 848 - DNA, 45 bp, Homo sapiens
tgtgccagcagcgtaggcgggagcgcctacaatgagcagttcttc

SEQ ID NO: 849 - DNA, 48 bp, Homo sapiens
tgtgccagcagcgtagggcatgggtctggggccaacgtcctgactttc

SEQ ID NO: 850 - DNA, 45 bp, Homo sapiens
tgtgccagcagcgtgggacacctcctgaccggggagctgtttttt

SEQ ID NO: 851 - DNA, 51 bp, Homo sapiens
tgtgccagcagcgtcggactagcgggacccccagcctacgagcagtacttc

SEQ ID NO: 852 - DNA, 51 bp, Homo sapiens
tgtgccagcagcgtcggactagcgggacccccagcctacgtgcagtacttc

SEQ ID NO: 853 - DNA, 51 bp, Homo sapiens
tgtgccagcagcgtcggactaccgggacccccagcctacgagcagtacttc

SEQ ID NO: 854 - DNA, 45 bp, Homo sapiens
tgtgccagcagcgtaggcaatagcgggaaagagacccagtacttc

SEQ ID NO: 855 - DNA, 45 bp, Homo sapiens
tgtgccagcagcgtagggagcggtacgggatcacccctccacttt

SEQ ID NO: 856 - DNA, 45 bp, Homo sapiens
tgtgccagcagcgtcgggacaggggggatgtgggagcagtacttc

SEQ ID NO: 857 - DNA, 48 bp, Homo sapiens
tgtgccagcagcgtaggggtggagggggtcaattcacccctccacttt

SEQ ID NO: 858 - DNA, 51 bp, Homo sapiens
tgtgccagcagcgtccctcgactagcgggaggtcacaatgagcagttcttc

SEQ ID NO: 859 - DNA, 42 bp, Homo sapiens
tgtgccagcagcgtaccttatcggggaggtgagcagttcttc

SEQ ID NO: 860 - DNA, 42 bp, Homo sapiens
tgtgccagcagcgtccagcgggagggcggtgagcagtacttc

SEQ ID NO: 861 - DNA, 42 bp, Homo sapiens
tgtgccagcagcgtaaggtgggagggctacgagcagtacttc

SEQ ID NO: 862 - DNA, 42 bp, Homo sapiens
tgtgccagcagcgtatcgggcgcctacaatgagcagttcttc

SEQ ID NO: 863 - DNA, 42 bp, Homo sapiens
tgtgccagcagcgtatcgggagactacaatgagcagttcttc

SEQ ID NO: 864 - DNA, 42 bp, Homo sapiens
tgtgccagcagcgtatccgggggcaatcagccccagcatttt

SEQ ID NO: 865 - DNA, 51 bp, Homo sapiens
tgtgccagcagcgtatctgggactcaacccgacaccggggagctgtttttt

SEQ ID NO: 866 - DNA, 45 bp, Homo sapiens
tgtgccagcagcgtcaccgggacaaccacagatacgcagtatttt

SEQ ID NO: 867 - DNA, 45 bp, Homo sapiens
tgtgccagcagcgtaaccactggggggggaaacaccatatatttt

SEQ ID NO: 868 - DNA, 48 bp, Homo sapiens
tgtgccagcagcgtagttcccagcgggatgtatggtgagcagttcttc

SEQ ID NO: 869 - DNA, 54 bp, Homo sapiens
tgtgccagcagcgtagtgactagcgggaggaggtcctacaatgagcagttcttc

SEQ ID NO: 870 - DNA, 42 bp, Homo sapiens
tgtgccagcagcgtctacgacggcacagatacgcagtatttt

SEQ ID NO: 871 - DNA, 54 bp, Homo sapiens
tgtgccagcaccgccaatagcgaaggctcttacggggccaacgtcctgactttc

SEQ ID NO: 872 - DNA, 48 bp, Homo sapiens
tgtgccatcagtgccgactattccagctcctacaatgagcagttcttc

SEQ ID NO: 873 - DNA, 42 bp, Homo sapiens
tgtgccatcagtgagtcagggagctcctacgagcagtacttc

SEQ ID NO: 874 - DNA, 45 bp, Homo sapiens
tgtgccatcagtgagtcgatagcgggggtcaatgagcagttcttc

SEQ ID NO: 875 - DNA, 54 bp, Homo sapiens
tgtgccatcagtgagtcacctgggggggctcggaacacagatacgcagtatttt

SEQ ID NO: 876 - DNA, 48 bp, Homo sapiens
tgtgccatcagtggggatgtcgagagctcctacaatgagcagttcttc

SEQ ID NO: 877 - DNA, 42 bp, Homo sapiens
tgtgccatcagtggatcgcgacaggagaatgagcagttcttc

SEQ ID NO: 878 - DNA, 42 bp, Homo sapiens
tgtgccatcagtagcctagcgggagaagatacgcagtatttt

SEQ ID NO: 879 - DNA, 42 bp, Homo sapiens
tgcgccagcagtgggggactagcgggatacgagcagtacttc

SEQ ID NO: 880 - DNA, 39 bp, Homo sapiens
tgtgccacaaaggacggggattcctacgagcagtacttc

SEQ ID NO: 881 - DNA, 42 bp, Homo sapiens
tgtgccacccagggcgggggagtgaacactgaagctttcttt

SEQ ID NO: 882 - DNA, 45 bp, Homo sapiens
tgtgccaccgtctctagcgagggcggccccggggagctgtttttt

SEQ ID NO: 883 - DNA, 39 bp, Homo sapiens
tgtgccagcaacttatggcctggggaaaggcaatacttc

SEQ ID NO: 884 - DNA, 39 bp, Homo sapiens
tgtgccagcagaattctgggatacaatgagcagttcttc

SEQ ID NO: 885 - DNA, 36 bp, Homo sapiens
tgtgccagcagaccggggtacaatgagcagttcttc

SEQ ID NO: 886 - DNA, 36 bp, Homo sapiens
tgtgccagcagctttgagcgcactgaagctttcttt

SEQ ID NO: 887 - DNA, 42 bp, Homo sapiens
tgtgccagcagcttcggtggggtgtacaatgagcagttcttc

SEQ ID NO: 888 - DNA, 36 bp, Homo sapiens
tgtgccagcagcttcgggcagtacgagcagtacttc

SEQ ID NO: 889 - DNA, 36 bp, Homo sapiens
tgtgccagcagctttagaagcaatgagcagttcttc

SEQ ID NO: 890 - DNA, 48 bp, Homo sapiens
tgtgccagcagcggcccccggacagggatcaccggggagctgtttttt

SEQ ID NO: 891 - DNA, 42 bp, Homo sapiens
tgtgccagcagcgggacgggagctaactatggctacaccttc

SEQ ID NO: 892 - DNA, 39 bp, Homo sapiens
tgtgccagcagcatagtcgggggaaacattcagtacttc

SEQ ID NO: 893 - DNA, 33 bp, Homo sapiens
tgtgccagcagcaaggggaagacccagtacttc

SEQ ID NO: 894 - DNA, 51 bp, Homo sapiens
tgtgccagcagcttagccccgggaagggagcatacgacacccctccacttt

SEQ ID NO: 895 - DNA, 42 bp, Homo sapiens
tgtgccagcagcttagcgagggagaacactgaagctttcttt

SEQ ID NO: 896 - DNA, 45 bp, Homo sapiens
tgtgccagcagcttagacccccaggggaacactgaagctttcttt

SEQ ID NO: 897 - DNA, 42 bp, Homo sapiens
tgtgccagcagcttagactcgggcacagatacgcagtatttt

SEQ ID NO: 898 - DNA, 39 bp, Homo sapiens
tgtgccagcagcttagattacatgcagccccagcatttt

SEQ ID NO: 899 - DNA, 45 bp, Homo sapiens
tgtgccagcagcttagaggccgcggtatcctacgagcagtacttc

SEQ ID NO: 900 - DNA, 48 bp, Homo sapiens
tgtgccagcagcttgggggcccgcgggaaccaagagacccagtacttc

SEQ ID NO: 901 - DNA, 45 bp, Homo sapiens
tgtgccagcagcttagggggactagcgcgatacgagcagtacttc

SEQ ID NO: 902 - DNA, 42 bp, Homo sapiens
tgtgccagcagcctcggactagctgcagatacgcagtatttt

SEQ ID NO: 903 - DNA, 39 bp, Homo sapiens
tgtgccagcagccttttacagggtggtgaagctttcttt

SEQ ID NO: 904 - DNA, 45 bp, Homo sapiens
tgtgccagcagcttacgggacaggaacaccggggagctgtttttt

SEQ ID NO: 905 - DNA, 57 bp, Homo sapiens
tgtgccagcagcttagttgggacaccgactagcgggagaggcaatgagcagttcttc

SEQ ID NO: 906 - DNA, 51 bp, Homo sapiens
tgtgccagcagcttagtcccagtccagggggctatcaatgagcagttcttc

SEQ ID NO: 907 - DNA, 39 bp, Homo sapiens
tgtgccagcagcatgggggtttcctacgagcagtacttc

SEQ ID NO: 908 - DNA, 48 bp, Homo sapiens
tgtgccagcagccccgggacagcctgggtccaagagacccagtacttc

SEQ ID NO: 909 - DNA, 45 bp, Homo sapiens
tgtgccagcagccgaactagcgggagtttcgacgagcagtacttc

SEQ ID NO: 910 - DNA, 39 bp, Homo sapiens
tgtgccagcagctccgcggacagtccggggcagtacttc

SEQ ID NO: 911 - DNA, 45 bp, Homo sapiens
tgtgccagcagctccgggactagcgcgtacaatgagcagttcttc

SEQ ID NO: 912 - DNA, 51 bp, Homo sapiens
tgtgccagcagctccccggtgggcccccgtaggtttggtgagcagttcttc

SEQ ID NO: 913 - DNA, 54 bp, Homo sapiens
tgtgccagcagctccccctggctagcgggagttttccaagagacccagtacttc

SEQ ID NO: 914 - DNA, 45 bp, Homo sapiens
tgtgccagcagcacagccgggactagagtgaatgagcagttcttc

SEQ ID NO: 915 - DNA, 57 bp, Homo sapiens
tgtgccagcagcaccgtccggcacgcgcagacagcgaacaccggggagctgtttttt

SEQ ID NO: 916 - DNA, 39 bp, Homo sapiens
tgtgccagcagcgttagccctaccggggagctgtttttt

SEQ ID NO: 917 - DNA, 42 bp, Homo sapiens
tgtgccagcagctggaggggcggcacagatacgcagtatttt

SEQ ID NO: 918 - DNA, 42 bp, Homo sapiens
tgtgccagcagctatgaggcctctcaagagacccagtacttc

SEQ ID NO: 919 - DNA, 39 bp, Homo sapiens
tgtgccagcaccgttggccctaccggggagccgtttttt

SEQ ID NO: 920 - DNA, 48 bp, Homo sapiens
tgtgctagtgctttgggggctagcgggcggaccggggagctgtttttt

SEQ ID NO: 921 - DNA, 39 bp, Homo sapiens
tgtgccagcgacaggactatgagcactgaagctttcttt

SEQ ID NO: 922 - DNA, 39 bp, Homo sapiens
tgtgccagcgacagtcccctgaacactgaagctttcttt

SEQ ID NO: 923 - DNA, 39 bp, Homo sapiens
tgtgccagcgacagtactatgaacactgaagctttcttt

SEQ ID NO: 924 - DNA, 48 bp, Homo sapiens
tgtgccagcgaaagttctagcgggagtgactacaatgagcagttcttc

SEQ ID NO: 925 - DNA, 42 bp, Homo sapiens
tgtgccagcttccacggggtgctatacaatgagcagttcttc

SEQ ID NO: 926 - DNA, 36 bp, Homo sapiens
tgtgccagcggagacagtttaagggagcagttcttc

SEQ ID NO: 927 - DNA, 42 bp, Homo sapiens
tgtgctagtggtttggcaaccaatccctacgagcagtacttc

SEQ ID NO: 928 - DNA, 36 bp, Homo sapiens
tgtgctagtggtttggtggctggggagctgtttttt

SEQ ID NO: 929 - DNA, 45 bp, Homo sapiens
tgtgctagtggtttggttcagggaagttactacgagcagtacttc

SEQ ID NO: 930 - DNA, 36 bp, Homo sapiens
tgtgccagcggccagggtagctatggctacaccttc

SEQ ID NO: 931 - DNA, 36 bp, Homo sapiens
tgtgccagcggcagggaaaatggcgagcagtacttc

SEQ ID NO: 932 - DNA, 45 bp, Homo sapiens
tgtgccagcaaatctttttttcaggctcaagagacccagtacttc

SEQ ID NO: 933 - DNA, 45 bp, Homo sapiens
tgtgccagtcttttattccaggctccccccgtcgagcagtacttc

SEQ ID NO: 934 - DNA, 39 bp, Homo sapiens
tgtgccagcaacgaagaaagggcagatacgcagtatttt

SEQ ID NO: 935 - DNA, 42 bp, Homo sapiens
tgtgccagcaggggacagggggctttgcagccccagcatttt

SEQ ID NO: 936 - DNA, 39 bp, Homo sapiens
tgtgccagcagggggacaggggataatgagcagttcttc

SEQ ID NO: 937 - DNA, 54 bp, Homo sapiens
tgtgccagcagacccaagtttagcgaccccgggccaaacaatgagcagttcttc

SEQ ID NO: 938 - DNA, 48 bp, Homo sapiens
tgtgccagcagatccctcgggacaccacgtctcaatgagcagttcttc

SEQ ID NO: 939 - DNA, 45 bp, Homo sapiens
tgtgccagcagcgcccggacagtagccaaaaacattcagtacttc

SEQ ID NO: 940 - DNA, 39 bp, Homo sapiens
tgtgccagcagtttcgcgggacccactgaagctttcttt

SEQ ID NO: 941 - DNA, 39 bp, Homo sapiens
tgtgccagcagttttgggggaatcgatggctacaccttc

SEQ ID NO: 942 - DNA, 45 bp, Homo sapiens
tgtgccagcagtttcttagcgggagccggcaatgagcagttcttc

SEQ ID NO: 943 - DNA, 48 bp, Homo sapiens
tgtgccagcagttttctccctagcgccctttgggatgagcagttcttc

SEQ ID NO: 944 - DNA, 48 bp, Homo sapiens
tgtgccagcagttttaggatcgagacagggaggtacggctacaccttc

SEQ ID NO: 945 - DNA, 54 bp, Homo sapiens
tgtgccagcagtttttctcgaggcggtgttgggaggcgggagacccaggacttc

SEQ ID NO: 946 - DNA, 48 bp, Homo sapiens
tgtgccagcagtttctcgacctgttcggctaactatggctacaccttc

SEQ ID NO: 947 - DNA, 39 bp, Homo sapiens
tgtgccagcagcataacaggagcctatggctacaccttc

SEQ ID NO: 948 - DNA, 45 bp, Homo sapiens
tgtgccagcagcaaggacaggggaagccaagagacccagtacttc

SEQ ID NO: 949 - DNA, 39 bp, Homo sapiens
tgtgccagcagtttggcggcctacaatgagcagttcttc

SEQ ID NO: 950 - DNA, 45 bp, Homo sapiens
tgtgccagcagtttagagggggcgccgggcactgaagctttcttt

SEQ ID NO: 951 - DNA, 45 bp, Homo sapiens
tgtgccagcagtttagaactgacaggccccctcggctacaccttc

SEQ ID NO: 952 - DNA, 36 bp, Homo sapiens
tgtgccagcagtttagaaaatcagccccagcatttt

SEQ ID NO: 953 - DNA, 45 bp, Homo sapiens
tgtgccagcagtttattctgggctccccccgacaagcagtacttc

SEQ ID NO: 954 - DNA, 45 bp, Homo sapiens
tgtgccagcagtttattctgggctccccccgtcgagcagtacttc

SEQ ID NO: 955 - DNA, 45 bp, Homo sapiens
tgtgccagcagtttattctggggtccccccgtcaagcagtacttc

SEQ ID NO: 956 - DNA, 33 bp, Homo sapiens
tgtgccagcagtttaggagagacccagtacttc

SEQ ID NO: 957 - DNA, 36 bp, Homo sapiens
tgtgccagcagtttggggggcagtgaagctttcttt

SEQ ID NO: 958 - DNA, 51 bp, Homo sapiens
tgtgccagcagtttagggtccgggacggccttgggcaatgagcagttcttc

SEQ ID NO: 959 - DNA, 42 bp, Homo sapiens
tgtgccagcagtttaggcagcctgaacactgaagctttcttt

SEQ ID NO: 960 - DNA, 48 bp, Homo sapiens
tgtgccagcagtttagggactagcgggagatggaatgaacagttcttc

SEQ ID NO: 961 - DNA, 48 bp, Homo sapiens
tgtgccagcagtttaaatccctcaggggacctctatggctacaccttc

SEQ ID NO: 962 - DNA, 42 bp, Homo sapiens
tgtgccagcagtttatccggggaattctacgagcagtacttc

SEQ ID NO: 963 - DNA, 39 bp, Homo sapiens
tgtgccagcagtttatcaggaggtaacgagcagtacttc

SEQ ID NO: 964 - DNA, 45 bp, Homo sapiens
tgtgccagcagtttaagtataagcgggggggtcgagcagttcttc

SEQ ID NO: 965 - DNA, 45 bp, Homo sapiens
tgtgccagcagtttaaccgggatcgaccaagagacccagtacttc

SEQ ID NO: 966 - DNA, 45 bp, Homo sapiens
tgtgccagcagtttgacctccggggttggggagacccagtacttc

SEQ ID NO: 967 - DNA, 42 bp, Homo sapiens
tgtgccagcagtttaactagcggctacaatgagcagttcttc

SEQ ID NO: 968 - DNA, 45 bp, Homo sapiens
tgtgccagcagtttagtggcggggggcgaaaatgagcagttcttc

SEQ ID NO: 969 - DNA, 42 bp, Homo sapiens
tgtgccagcagtttagtgggagggacctacgagcagtacttc

SEQ ID NO: 970 - DNA, 42 bp, Homo sapiens
tgtgccagcagtctgtatagcgggaggcatgagcagttcttc

SEQ ID NO: 971 - DNA, 33 bp, Homo sapiens
tgtgccagcagtcccgccggggagctgtttttt

SEQ ID NO: 972 - DNA, 48 bp, Homo sapiens
tgtgccagcagtcccattactagagctcctgacaatgagcagttcttc

SEQ ID NO: 973 - DNA, 45 bp, Homo sapiens
tgtgccagcagccctcgggacagggttttttacgagcagtacttc

SEQ ID NO: 974 - DNA, 51 bp, Homo sapiens
tgtgccagcagcccccggactagcggtagagggacagatacgcagtatttt

SEQ ID NO: 975 - DNA, 42 bp, Homo sapiens
tgtgccagcagccctagcggggattacaatgagcagttcttc

SEQ ID NO: 976 - DNA, 39 bp, Homo sapiens
tgtgccagcagtcccacaggggccggggagctgtttttt

SEQ ID NO: 977 - DNA, 39 bp, Homo sapiens
tgtgccagcagccggacagggtcagatacgcagtatttt

SEQ ID NO: 978 - DNA, 42 bp, Homo sapiens
tgtgccagcagttcgggcggcggctcctacgagcagtacttc

SEQ ID NO: 979 - DNA, 42 bp, Homo sapiens
tgtgccagcagttcaggacagggcaatcagccccagcatttt

SEQ ID NO: 980 - DNA, 42 bp, Homo sapiens
tgtgccagcagttctattgatggattctacgagcagtacttc

SEQ ID NO: 981 - DNA, 54 bp, Homo sapiens
tgtgccagcagttccccgatctatcgaggacagcttaactatggctacaccttc

SEQ ID NO: 982 - DNA, 42 bp, Homo sapiens
tgtgccagcagtaccgggaccccactctacgagcagtacttc

SEQ ID NO: 983 - DNA, 51 bp, Homo sapiens
tgtgccagcagtacactagcgggaggttctcacaccggggagctgtttttt

SEQ ID NO: 984 - DNA, 39 bp, Homo sapiens
tgtgccagcagtgtggcgtcctacaatgagcagttcttc

SEQ ID NO: 985 - DNA, 48 bp, Homo sapiens
tgtgccagcagttgggacctaacaggggagggtagggtggctttcttt

SEQ ID NO: 986 - DNA, 51 bp, Homo sapiens
tgtgccagcagttggactagcgggagctcgggctacaatgagcagttcttc

SEQ ID NO: 987 - DNA, 45 bp, Homo sapiens
tgtgccagcacgtctagcgggagggatcgagatacgcagtatttt

SEQ ID NO: 988 - DNA, 45 bp, Homo sapiens
tgtgccaccctttgtacccacggggttggggagacccagtacttc

SEQ ID NO: 989 - DNA, 57 bp, Homo sapiens
tgtggcatgagttcgggggaatggaagcgggggggccggggggatacttcttatttt

SEQ ID NO: 990 - DNA, 48 bp, Homo sapiens
tgtgccagcagacttacggggacctactataattcacccctccacttt

SEQ ID NO: 991 - DNA, 48 bp, Homo sapiens
tgtgccagcagcttcgggggagagggctcctacaatgagcagttcttc

SEQ ID NO: 992 - DNA, 45 bp, Homo sapiens
tgtgccagcagcttcagggctggtctactaggagagctgtttttt

SEQ ID NO: 993 - DNA, 51 bp, Homo sapiens
tgtgccagcagctttagcgggagtcagtttataagaaagacccagtacttc

SEQ ID NO: 994 - DNA, 48 bp, Homo sapiens
tgtgccagcagccacggactagcggggctcaccggggagctgtttttt

SEQ ID NO: 995 - DNA, 42 bp, Homo sapiens
tgtgccagcagcatccaaagggaccaggagacccagtacttc

SEQ ID NO: 996 - DNA, 42 bp, Homo sapiens
tgtgccagcagcttagctgctagcgggccggcgcagttcttc

SEQ ID NO: 997 - DNA, 45 bp, Homo sapiens
tgtgccagcagcttagcgcgcgggagaatccacgagcagtacttc

SEQ ID NO: 998 - DNA, 39 bp, Homo sapiens
tgtgccagcagcttagaagggttggacgagcagtacttc

SEQ ID NO: 999 - DNA, 36 bp, Homo sapiens
tgtgccagcagcttagggggtgatgagcagttcttc

SEQ ID NO: 1000 - DNA, 54 bp, Homo sapiens
tgtgccagcagcttaggccggactagcgggccccctagggatgagcagttcttc

SEQ ID NO: 1001 - DNA, 48 bp, Homo sapiens
tgtgccagcagcttaggggttggtgtcgatggggagacccagtacttc

SEQ ID NO: 1002 - DNA, 45 bp, Homo sapiens
tgtgccagcagcttaggttacgggtcaacctacgagcagtacttc

SEQ ID NO: 1003 - DNA, 33 bp, Homo sapiens
tgtgccagcagcctccggggggagcagtacttc

SEQ ID NO: 1004 - DNA, 33 bp, Homo sapiens
tgtgccagcagcttagtgctgactcctttcttt

SEQ ID NO: 1005 - DNA, 42 bp, Homo sapiens
tgtgccagcagcttagtgacaccgggaaacaccatatatttt

SEQ ID NO: 1006 - DNA, 42 bp, Homo sapiens
tgtgccagcagcttatggcggaactcctacgagcagtacttc

SEQ ID NO: 1007 - DNA, 45 bp, Homo sapiens
tgtgccagcagcaacccgggacagggggactcacccctccacttt

SEQ ID NO: 1008 - DNA, 42 bp, Homo sapiens
tgtgccagcagcccacgggacagtcaagagacccagtacttc

SEQ ID NO: 1009 - DNA, 36 bp, Homo sapiens
tgtgccagcagccagtggaccggggagctgtttttt

SEQ ID NO: 1010 - DNA, 36 bp, Homo sapiens
tgtgccagcagccgaggattcgacaccatatatttt

SEQ ID NO: 1011 - DNA, 54 bp, Homo sapiens
tgtgccagcagctctgataaccccttagcgggagaaacagatacgcagtatttt

SEQ ID NO: 1012 - DNA, 51 bp, Homo sapiens
tgtgccagcagctcagaccggactagtcatcgcacagatacgcagtatttt

SEQ ID NO: 1013 - DNA, 39 bp, Homo sapiens
tgtgccagcagctccggcgagggtcagccccagcatttt

SEQ ID NO: 1014 - DNA, 45 bp, Homo sapiens
tgtgccagcagctcccctttcgagggaagggatacgcagtatttt

SEQ ID NO: 1015 - DNA, 45 bp, Homo sapiens
tgtgccagcagctcccgggacaggggaacctacgagcagtacttc

SEQ ID NO: 1016 - DNA, 45 bp, Homo sapiens
tgtgccagcagctccaggggggcccgcacagatacgcagtatttt

SEQ ID NO: 1017 - DNA, 39 bp, Homo sapiens
tgtgcccccagccactccccagggggaacgcactatttt

SEQ ID NO: 1018 - DNA, 42 bp, Homo sapiens
tgtgccagcagggaaccagggacaggcaaagagcagtacttc

SEQ ID NO: 1019 - DNA, 42 bp, Homo sapiens
tgtgccagcaggatttcagggggactaaatgagcagttcttc

SEQ ID NO: 1020 - DNA, 54 bp, Homo sapiens
tgtgccagcagccacgaccgggactacctttctgggacagatacgcagtatttt

SEQ ID NO: 1021 - DNA, 45 bp, Homo sapiens
tgtgccagcagcttactagcgggctcctacaatgagcagttcttc

SEQ ID NO: 1022 - DNA, 51 bp, Homo sapiens
tgtgccagcagccaagatccctttcgtggtggctcctacgagcagtacttc

SEQ ID NO: 1023 - DNA, 36 bp, Homo sapiens
tgtgccagcagccaagatagggtagcgcagttcttc

SEQ ID NO: 1024 - DNA, 51 bp, Homo sapiens
tgtgccagcagccaagattacacgactagcagacacaatgagcagttcttc

SEQ ID NO: 1025 - DNA, 57 bp, Homo sapiens
tgtgccagcagccaagaaggggagcggacccgaaggggcaccggggagctgtttttt

SEQ ID NO: 1026 - DNA, 54 bp, Homo sapiens
tgtgccagcagccaagagaccctagcgggttggtaccaagagacccagtacttc

SEQ ID NO: 1027 - DNA, 42 bp, Homo sapiens
tgtgccagcagccaagaatgggggcaagagacccagtacttc

SEQ ID NO: 1028 - DNA, 39 bp, Homo sapiens
tgtgccagcagccaaggggctcgcactgaagctttcttt

SEQ ID NO: 1029 - DNA, 57 bp, Homo sapiens
tgtgccagcagccaaggtgccagcgggagggccaagggcacagatacgcagtatttt

SEQ ID NO: 1030 - DNA, 51 bp, Homo sapiens
tgtgccagcagccagggcctagcgggagttacctcctacgagcagtacttc

SEQ ID NO: 1031 - DNA, 39 bp, Homo sapiens
tgtgccagcagccaaggccggggtaaagagcagtacttc

SEQ ID NO: 1032 - DNA, 54 bp, Homo sapiens
tgtgccagcagccaaccaactcgacagggaccgaacaccggggagctgtttttt

SEQ ID NO: 1033 - DNA, 39 bp, Homo sapiens
tgtgccagcagccagtccccagggggaacgcagtatttt

SEQ ID NO: 1034 - DNA, 42 bp, Homo sapiens
tgtgccagctcgactagcggccaccaagagacccagtacttc

SEQ ID NO: 1035 - DNA, 36 bp, Homo sapiens
tgtgccatacaggggacctcagagacccagtacttc

SEQ ID NO: 1036 - DNA, 42 bp, Homo sapiens
tgtgccaccggacctgagcgcgtagtcgatgagcagttcttc

SEQ ID NO: 1037 - DNA, 51 bp, Homo sapiens
tgtgccacccgaaagcctaacgaaccgagctcctacaatgagcagttcttc

SEQ ID NO: 1038 - DNA, 42 bp, Homo sapiens
tgtgccaccagattaaaaggcggctacaatgagcagttcttc

SEQ ID NO: 1039 - DNA, 39 bp, Homo sapiens
tgtgccaccagcgctcatggaggagagacccagtacttc

SEQ ID NO: 1040 - DNA, 51 bp, Homo sapiens
tgtgccaccagcgacgagggacagggggcgcgcaccggggagctgtttttt

SEQ ID NO: 1041 - DNA, 39 bp, Homo sapiens
tgtgccaccagcggactagcgggagaggagcagttcttc

SEQ ID NO: 1042 - DNA, 48 bp, Homo sapiens
tgtgccaccagcatagcaggtaccatgaacaccggggagcagtttttt

SEQ ID NO: 1043 - DNA, 39 bp, Homo sapiens
tgtgccaccagcatagtcgcgggcgagaacaatttcttc

SEQ ID NO: 1044 - DNA, 48 bp, Homo sapiens
tgtgccaccagcaaagattacacaggctcctacaatgagcagttcttc

SEQ ID NO: 1045 - DNA, 42 bp, Homo sapiens
tgtgccaccagtctaactagcgggtacaatgagcagttcttc

SEQ ID NO: 1046 - DNA, 39 bp, Homo sapiens
tgtgccaccagcaaccatggcggagagacccagtacttc

SEQ ID NO: 1047 - DNA, 42 bp, Homo sapiens
tgtgccaccagccccggcgggagtctgagcgagcagtacttc

SEQ ID NO: 1048 - DNA, 45 bp, Homo sapiens
tgtgccaccagccctcgggacaccgtacaagagacccaatacttc

SEQ ID NO: 1049 - DNA, 39 bp, Homo sapiens
tgtgccaccagcagggcggccgggtacgagcagtacttc

SEQ ID NO: 1050 - DNA, 42 bp, Homo sapiens
tgtgccaccagcagagcaggggccaatcagccccagcatttt

SEQ ID NO: 1051 - DNA, 45 bp, Homo sapiens
tgtgccaccagcagagcaaggacaggccttaatgagcagttcttc

SEQ ID NO: 1052 - DNA, 42 bp, Homo sapiens
tgtgccaccagcagagatgccggacagtacgagcagtacttc

SEQ ID NO: 1053 - DNA, 48 bp, Homo sapiens
tgtgccaccagcagagatgggactagcgggaggtacgagcagtacttc

SEQ ID NO: 1054 - DNA, 48 bp, Homo sapiens
tgtgccaccagcagagatcacgcagcttcttcttggccccagcatttt

SEQ ID NO: 1055 - DNA, 48 bp, Homo sapiens
tgtgccaccagcagagatcctagcgggagggcagatacgcagtatttt

SEQ ID NO: 1056 - DNA, 48 bp, Homo sapiens
tgtgccaccagcagagatcccagcaggcgaattgagacccagtacttc

SEQ ID NO: 1057 - DNA, 42 bp, Homo sapiens
tgtgccaccagcagggacaggggcgacaatgagcagttcttc

SEQ ID NO: 1058 - DNA, 48 bp, Homo sapiens
tgtgccaccagcagggaacagggctctggggccaacgtcctgactttc

SEQ ID NO: 1059 - DNA, 51 bp, Homo sapiens
tgtgccaccagcagagaaaccgggacagggggatcagatacgcagtatttt

SEQ ID NO: 1060 - DNA, 48 bp, Homo sapiens
tgtgccaccagcagagaggtgggggtaggaagcactgaagctttcttt

SEQ ID NO: 1061 - DNA, 51 bp, Homo sapiens
tgtgccaccagcagaggagagctactagcgggagcatccgagcagtacttc

SEQ ID NO: 1062 - DNA, 45 bp, Homo sapiens
tgtgccaccagcagagggaaagggggggaagagacccagtacttc

SEQ ID NO: 1063 - DNA, 42 bp, Homo sapiens
tgtgccaccagcaggggacagggggcgagagagcagtacttc

SEQ ID NO: 1064 - DNA, 48 bp, Homo sapiens
tgtgccaccagcaggggacagcttagctcctacaatgagcagttcttc

SEQ ID NO: 1065 - DNA, 45 bp, Homo sapiens
tgtgccaccagcagagggaggggagagagtcagccccagcatttt

SEQ ID NO: 1066 - DNA, 51 bp, Homo sapiens
tgtgccaccagcagaggtacagggaggagagggacagatacgcagtatttt

SEQ ID NO: 1067 - DNA, 42 bp, Homo sapiens
tgtgccaccagcagagggactagcgccaatgagcagttcttc

SEQ ID NO: 1068 - DNA, 48 bp, Homo sapiens
tgtgccaccagcagacgtctagcggattcctcctacgagcagtacttc

SEQ ID NO: 1069 - DNA, 42 bp, Homo sapiens
tgtgccaccagtagaaggacagctccctacgagcagtacttc

SEQ ID NO: 1070 - DNA, 45 bp, Homo sapiens
tgtgccaccagcagatcatcgggacagtggtacgagcagtacttc

SEQ ID NO: 1071 - DNA, 39 bp, Homo sapiens
tgtgccaccagcagagtttccggagatgaagctttcttt

SEQ ID NO: 1072 - DNA, 39 bp, Homo sapiens
tgtgccaccagtcggtgggggggtgagacccagtacttc

SEQ ID NO: 1073 - DNA, 45 bp, Homo sapiens
tgtgccaccagccgataccgggagagcaattcacccctccacttt

SEQ ID NO: 1074 - DNA, 45 bp, Homo sapiens
tgtgccaccagcagcgcagcaactagcacagatacgcagtatttt

SEQ ID NO: 1075 - DNA, 42 bp, Homo sapiens
tgtgccaccagcagcttcggcacacagtacgagcagtacttc

SEQ ID NO: 1076 - DNA, 39 bp, Homo sapiens
tgtgccaccagcagccacgggggagagacccagtacttc

SEQ ID NO: 1077 - DNA, 39 bp, Homo sapiens
tgtgccacgtcatccacggcaggggagacccagtacttc

SEQ ID NO: 1078 - DNA, 39 bp, Homo sapiens
tgtgccaccagcaccgtcgcgggcgagacccagtacttc

SEQ ID NO: 1079 - DNA, 42 bp, Homo sapiens
tgtgccagctcacccgaggtgagccaagagacccagtacttc

SEQ ID NO: 1080 - DNA, 42 bp, Homo sapiens
tgtgccagctccccgggggcagggaacactgaagctttcttt

SEQ ID NO: 1081 - DNA, 51 bp, Homo sapiens
tgtgccagctcacccgggcagtcaggagagtttggaaacaccatatatttt

SEQ ID NO: 1082 - DNA, 39 bp, Homo sapiens
tgtgccagctcaccagggtcgggtcagccccagcatttt

SEQ ID NO: 1083 - DNA, 48 bp, Homo sapiens
tgtgccagctcacctcccgacaggagaactggaaacaccatatatttt

SEQ ID NO: 1084 - DNA, 48 bp, Homo sapiens
tgtgccagctcaccaccggtggcggcattagaatcacccctccacttt

SEQ ID NO: 1085 - DNA, 42 bp, Homo sapiens
tgtgccagctcaccacgggacggggccaatgagcagttcttc

SEQ ID NO: 1086 - DNA, 51 bp, Homo sapiens
tgtgccagctcaccggtacagggggcctctggggccaacgtcctgactttc

SEQ ID NO: 1087 - DNA, 45 bp, Homo sapiens
tgtgccagctcacaaggacagggctccaccggggagctgtttttt

SEQ ID NO: 1088 - DNA, 48 bp, Homo sapiens
tgtgccagctcgcgtaccgggcccgaatctccctacgagcagtacttc

SEQ ID NO: 1089 - DNA, 42 bp, Homo sapiens
tgtgccagctcccggactacgaacaccggggagctgtttttt

SEQ ID NO: 1090 - DNA, 48 bp, Homo sapiens
tgtgccagtgctgggggtcggctagcggtgagagatacgcagtatttt

SEQ ID NO: 1091 - DNA, 36 bp, Homo sapiens
tgtgccagcgaagaccaagtagatacgcagtatttt

SEQ ID NO: 1092 - DNA, 42 bp, Homo sapiens
tgtgccagcggacagaaaacctctggaaacaccatatatttt

SEQ ID NO: 1093 - DNA, 30 bp, Homo sapiens
tgtgccagtgggtcgggtggctacaccttc

SEQ ID NO: 1094 - DNA, 36 bp, Homo sapiens
tgtgccagtgggacaggaccctacgagcagtacttc

SEQ ID NO: 1095 - DNA, 39 bp, Homo sapiens
tgtgccagtcatggcagggtagggactgaagctttcttt

SEQ ID NO: 1096 - DNA, 45 bp, Homo sapiens
tgtgccagtatacagggggctgggagcaatcagccccagcatttt

SEQ ID NO: 1097 - DNA, 39 bp, Homo sapiens
tgtgccagtctagcgggagggcttaatgagcagttcttc

SEQ ID NO: 1098 - DNA, 48 bp, Homo sapiens
tgtgccagtatgattccttcgacagggggccgggctgaagctttcttt

SEQ ID NO: 1099 - DNA, 45 bp, Homo sapiens
tgtgcctcccagggactagcaggctcctacaatgagcagttcttc

SEQ ID NO: 1100 - DNA, 36 bp, Homo sapiens
tgtgccagccggggagactcctacgagcagtacttc

SEQ ID NO: 1101 - DNA, 39 bp, Homo sapiens
tgtgccagtagacactggctaaccggggagctgtttttt

SEQ ID NO: 1102 - DNA, 39 bp, Homo sapiens
tgtgccagtcgctcagggcccaccggggagctgtttttt

SEQ ID NO: 1103 - DNA, 45 bp, Homo sapiens
tgtgccagtaggtctagcggggggaacctctacgagcagtacttc

SEQ ID NO: 1104 - DNA, 42 bp, Homo sapiens
tgtgccagccgggtagcagcatacaatcagccccagcatttt

SEQ ID NO: 1105 - DNA, 45 bp, Homo sapiens
tgtgccagtcgagtagcgggagggccctacaatgagcagttcttc

SEQ ID NO: 1106 - DNA, 39 bp, Homo sapiens
tgtgccagtagcgccgggacggcgtatggctacaccttc

SEQ ID NO: 1107 - DNA, 42 bp, Homo sapiens
tgtgccagtagtgccctactagcccctggggagctgtttttt

SEQ ID NO: 1108 - DNA, 51 bp, Homo sapiens
tgtgccagtagtgcgactagcgggagtgggaactacaatgagcagttcttc

SEQ ID NO: 1109 - DNA, 51 bp, Homo sapiens
tgtgccagtagcttcactagcgggagtatatgggccggggagctgtttttt

SEQ ID NO: 1110 - DNA, 51 bp, Homo sapiens
tgtgccagtagcggactagcgggatcctcccgggcagatacgcagtatttt

SEQ ID NO: 1111 - DNA, 51 bp, Homo sapiens
tgtgccagtagcggactatcgggatcctcccgggcagatacgcattatttt

SEQ ID NO: 1112 - DNA, 48 bp, Homo sapiens
tgtgccagtagtggaagacagggaaagaacaccggggagctgtttttt

SEQ ID NO: 1113 - DNA, 36 bp, Homo sapiens
tgtgccagtagtatagcggaccgagaagctttcttt

SEQ ID NO: 1114 - DNA, 39 bp, Homo sapiens
tgtgccagtagtatagcgggttacaatgagcagttcttc

SEQ ID NO: 1115 - DNA, 42 bp, Homo sapiens
tgtgccagtagtatagctgtgggactaaatgagcagttcttc

SEQ ID NO: 1116 - DNA, 48 bp, Homo sapiens
tgtgccagtagtatagatggcggagcgggcgtctacgagcagtacttc

SEQ ID NO: 1117 - DNA, 39 bp, Homo sapiens
tgtgccagtagtatcgacaaacccaatgagcagttcttc

SEQ ID NO: 1118 - DNA, 45 bp, Homo sapiens
tgtgccagtagtatagactcggacctcaatcagccccagcatttt

SEQ ID NO: 1119 - DNA, 51 bp, Homo sapiens
tgtgccagtagtatagacactagcgggggctcctacaatgagcagttcttc

SEQ ID NO: 1120 - DNA, 48 bp, Homo sapiens
tgtgccagtagtatagattggacagggtatttggagacccagtacttc

SEQ ID NO: 1121 - DNA, 42 bp, Homo sapiens
tgtgccagtagtatcttctttggctcctacgagcagtacttc

SEQ ID NO: 1122 - DNA, 33 bp, Homo sapiens
tgtgccagtagtatcttcggcgagcagcacttc

SEQ ID NO: 1123 - DNA, 48 bp, Homo sapiens
tgtgccagtagtatttttgggacaagttacaccggggagctgtttttt

SEQ ID NO: 1124 - DNA, 45 bp, Homo sapiens
tgtgccagtagtataggtgctagcgggtctttggagcagttcttc

SEQ ID NO: 1125 - DNA, 48 bp, Homo sapiens
tgtgccagtagtatagggggactagcgggagcagatacgcagtatttt

SEQ ID NO: 1126 - DNA, 48 bp, Homo sapiens
tgtgccagtagtatagggggcacctacggcaatcagccccagcatttt

SEQ ID NO: 1127 - DNA, 54 bp, Homo sapiens
tgtgccagtagtatagggcacacaggcggactagccaaaaacattcagtacttc

SEQ ID NO: 1128 - DNA, 45 bp, Homo sapiens
tgtgccagtagtattgggcaggtctcctacaatgagcagttcttc

SEQ ID NO: 1129 - DNA, 48 bp, Homo sapiens
tgtgccagtagtatagggtcggggggctatttttatggctacaccttc

SEQ ID NO: 1130 - DNA, 42 bp, Homo sapiens
tgtgccagtagtatcgggacagggtcctacgagcagtacttc

SEQ ID NO: 1131 - DNA, 33 bp, Homo sapiens
tgtgccagtagtatcggctatggctacaccttc

SEQ ID NO: 1132 - DNA, 51 bp, Homo sapiens
tgtgccagtagtattatttcgggccgggacgcttacaatgagcagttcttc

SEQ ID NO: 1133 - DNA, 51 bp, Homo sapiens
tgtgccagtagtattaaacagggggccgggatgaacactgaagctttcttt

SEQ ID NO: 1134 - DNA, 36 bp, Homo sapiens
tgtgccagtagtatccttttcaatgagcagttcttc

SEQ ID NO: 1135 - DNA, 45 bp, Homo sapiens
tgtgccagtagtatcttactagcggcgtacaatgagcagttcttc

SEQ ID NO: 1136 - DNA, 42 bp, Homo sapiens
tgtgccagtagtatcttgttgggtcacaatgagcagttcttc

SEQ ID NO: 1137 - DNA, 39 bp, Homo sapiens
tgtgccagtagtattaatagcaatcagccccagcatttt

SEQ ID NO: 1138 - DNA, 42 bp, Homo sapiens
tgtgccagtagtataagggacagccaagagacccagtacttc

SEQ ID NO: 1139 - DNA, 48 bp, Homo sapiens
tgtgccagtagtatctccgggacagggtctaatcagccccagcatttt

SEQ ID NO: 1140 - DNA, 45 bp, Homo sapiens
tgtgccagtagtatatccagggacagggcgcgagagcagtacttc

SEQ ID NO: 1141 - DNA, 45 bp, Homo sapiens
tgtgccagtagtataaccagcggggaaccttacgagcagtacttc

SEQ ID NO: 1142 - DNA, 39 bp, Homo sapiens
tgtgccagtagtatagttctcaatcagccccagcatttt

SEQ ID NO: 1143 - DNA, 45 bp, Homo sapiens
tgtgccagtagtatcgtcgtagacagttactacgagcagtacttc

SEQ ID NO: 1144 - DNA, 45 bp, Homo sapiens
tgtgccagtagtatttggggggggggtacccacccccaggttttt

SEQ ID NO: 1145 - DNA, 39 bp, Homo sapiens
tgtgccagtagtatctggccggccgacgagcagtacttc

SEQ ID NO: 1146 - DNA, 39 bp, Homo sapiens
tgtgccagtagtctagcgtccggcggggagctgtttttt

SEQ ID NO: 1147 - DNA, 42 bp, Homo sapiens
tgtgccagtagtctcctcgggggatcctacgagcagtacttc

SEQ ID NO: 1148 - DNA, 42 bp, Homo sapiens
tgtgccagtagtctacgatccagggagtacgagcagtacttc

SEQ ID NO: 1149 - DNA, 39 bp, Homo sapiens
tgtgccagtagtatggacccaggccagccccagcatttt

SEQ ID NO: 1150 - DNA, 39 bp, Homo sapiens
tgtgccagtagtatggggatgggggagccccagcatttt

SEQ ID NO: 1151 - DNA, 42 bp, Homo sapiens
tgtgccagtagtatgcttccagggacagatacgcagtatttt

SEQ ID NO: 1152 - DNA, 51 bp, Homo sapiens
tgtgccagtagtatgactagcgggggaagctcctacaatgagcagttcttc

SEQ ID NO: 1153 - DNA, 54 bp, Homo sapiens
tgtgccagtagtatggtacgtctccgggggactttgaacaatgagcagttcttc

SEQ ID NO: 1154 - DNA, 33 bp, Homo sapiens
tgtgccagtagtatgtacaatgagcagttcttc

SEQ ID NO: 1155 - DNA, 48 bp, Homo sapiens
tgtgccagtagtaatgctctagcgggaccttacaatgagcagttcttc

SEQ ID NO: 1156 - DNA, 42 bp, Homo sapiens
tgtgccagtagtaacggggcgatatggaatgagcagttcttc

SEQ ID NO: 1157 - DNA, 48 bp, Homo sapiens
tgtgccagtagtccggcaccgggacaggggaaagatggctacaccttc

SEQ ID NO: 1158 - DNA, 42 bp, Homo sapiens
tgtgccagtagtccaggactcaaaacgggtgagcagttcttc

SEQ ID NO: 1159 - DNA, 48 bp, Homo sapiens
tgtgccagtagccctatagggacaggggaagttcagccccagcatttt

SEQ ID NO: 1160 - DNA, 45 bp, Homo sapiens
tgtgccagtagccccccggggggaggccaggatacgcagtatttt

SEQ ID NO: 1161 - DNA, 48 bp, Homo sapiens
tgtgccagtagtcccacggacacaagctcctacaatgagcagttcttc

SEQ ID NO: 1162 - DNA, 45 bp, Homo sapiens
tgtgccagtagtccctatcgacagggggaggacattcagtacttc

SEQ ID NO: 1163 - DNA, 45 bp, Homo sapiens
tgtgccagtagccaggggtttaccagcaatcagccccagcatttt

SEQ ID NO: 1164 - DNA, 42 bp, Homo sapiens
tgtgccagcagtcagcagggcggtaattcacccctccacttt

SEQ ID NO: 1165 - DNA, 42 bp, Homo sapiens
tgtgccagtagtcagacagcaactaatgaaaaactgtttttt

SEQ ID NO: 1166 - DNA, 39 bp, Homo sapiens
tgtgccagtagtcaaacgggggcggatacgcagtatttt

SEQ ID NO: 1167 - DNA, 39 bp, Homo sapiens
tgtgccagtagccagacagggggctacgagcagtacttc

SEQ ID NO: 1168 - DNA, 45 bp, Homo sapiens
tgtgccagtagccgggacccctcggggatagatacgcagtatttt

SEQ ID NO: 1169 - DNA, 39 bp, Homo sapiens
tgtgccagtagtcgcggtttcagcaacgagcagtacttc

SEQ ID NO: 1170 - DNA, 45 bp, Homo sapiens
tgtgccagtagtcgactagcgattggcacagatacgcagtatttt

SEQ ID NO: 1171 - DNA, 48 bp, Homo sapiens
tgtgccagtagttccgccgaggagggcgtgggggaaaaactgtttttt

SEQ ID NO: 1172 - DNA, 45 bp, Homo sapiens
tgtgccagtagttcggcaggggggtggagcactgaagctttcttt

SEQ ID NO: 1173 - DNA, 66 bp, Homo sapiens
tgtgccagtagttccgaggtgtggggggacagggggctagcgggcccctacaatgagcagttcttc

SEQ ID NO: 1174 - DNA, 45 bp, Homo sapiens
tgtgccagtagttcccgacaggtgagctacaatgagcagttcttc

SEQ ID NO: 1175 - DNA, 48 bp, Homo sapiens
tgtgccagtagttcctcgtgggacagggtatacaatgagcagttcttc

SEQ ID NO: 1176 - DNA, 33 bp, Homo sapiens
tgtgccagtagtacggccggggagctgtttttt

SEQ ID NO: 1177 - DNA, 39 bp, Homo sapiens
tgtgccagtagtacagcggttgcctacgagcagtacttc

SEQ ID NO: 1178 - DNA, 51 bp, Homo sapiens
tgtgccagtagtacgggactagcgggagtccgcgccggggagctgtttttt

SEQ ID NO: 1179 - DNA, 57 bp, Homo sapiens
tgtgccagtagtacccatgaaggactagcgggagggcaaggggatgagcagttcttc

SEQ ID NO: 1180 - DNA, 48 bp, Homo sapiens
tgtgccagtagtacaaacgccgatgacctcaccggggagctgtttttt

SEQ ID NO: 1181 - DNA, 42 bp, Homo sapiens
tgtgccagtagtgtgggacaggggcggactgaagctttcttt

SEQ ID NO: 1182 - DNA, 45 bp, Homo sapiens
tgtgccagtagtgtccgggacggaggtacctacgagcagtacttc

SEQ ID NO: 1183 - DNA, 42 bp, Homo sapiens
tgtgccagtacaaacgggattaacaccggggagctgtttttt

SEQ ID NO: 1184 - DNA, 51 bp, Homo sapiens
tgtgccagtactccgggagaggggactagtcgtaccggggagctgtttttt

SEQ ID NO: 1185 - DNA, 33 bp, Homo sapiens
tgtgccagtgttcagggaggcgagcagtgcttc

SEQ ID NO: 1186 - DNA, 33 bp, Homo sapiens
tgtgccagtgttcagggaggcgagcagtacttc

SEQ ID NO: 1187 - DNA, 48 bp, Homo sapiens
tgtgccagttacggcccctggagagcgagctacaatgagcagttcttc

SEQ ID NO: 1188 - DNA, 30 bp, Homo sapiens
tgtgccactaaggccggggagctgtttttt

SEQ ID NO: 1189 - DNA, 42 bp, Homo sapiens
tgtgccagcagcaaatcccgagagaattcacccctccacttt

SEQ ID NO: 1190 - DNA, 54 bp, Homo sapiens
tgcagtgctgcccgggacaaactgcccctactctggggttacgagcagtacttc

SEQ ID NO: 1191 - DNA, 45 bp, Homo sapiens
tgcagtgctgacgcagggggcgcgaacaccggggagctgtttttt

SEQ ID NO: 1192 - DNA, 39 bp, Homo sapiens
tgcagtgcggataagactagttacaatgagcagttcttc

SEQ ID NO: 1193 - DNA, 33 bp, Homo sapiens
tgcagtgccgacagggaacctgaagctttcttt

SEQ ID NO: 1194 - DNA, 45 bp, Homo sapiens
tgcagtgctgacacagggggcgcgaacaccggggagctgtttttt

SEQ ID NO: 1195 - DNA, 45 bp, Homo sapiens
tgcagtgcagacactagcgtcccctcctacaatgagcagttcttc

SEQ ID NO: 1196 - DNA, 39 bp, Homo sapiens
tgcagtgctgagaccgggacatctatcgagcagtacttc

SEQ ID NO: 1197 - DNA, 45 bp, Homo sapiens
tgcagtgcttttcccccgggaggcccaagtgatacgcagtatttt

SEQ ID NO: 1198 - DNA, 42 bp, Homo sapiens
tgcagtgctggagcgggggcgggccaagagacccagtacttc

SEQ ID NO: 1199 - DNA, 51 bp, Homo sapiens
tgcagtgctggggggtgggacagggggctaaaagggactgaagctttcttt

SEQ ID NO: 1200 - DNA, 54 bp, Homo sapiens
tgcagtgctgggattatagtacgactagcagcaagcacagatacgcagtatttt

SEQ ID NO: 1201 - DNA, 39 bp, Homo sapiens
tgcagtgcaggacaggggggtaaagagacccagtacttc

SEQ ID NO: 1202 - DNA, 45 bp, Homo sapiens
tgcagtgctcacgcggcagggggagagggtcagccccagcatttt

SEQ ID NO: 1203 - DNA, 48 bp, Homo sapiens
tgcagtgctattgctagcgggagggccggcccagatacgcagtatttt

SEQ ID NO: 1204 - DNA, 42 bp, Homo sapiens
tgcagtgctatcgagggctcaggatggaacgagcagtacttc

SEQ ID NO: 1205 - DNA, 42 bp, Homo sapiens
tgcagtgcgatacgggcagggggccacgagacccagtacttc

SEQ ID NO: 1206 - DNA, 45 bp, Homo sapiens
tgcagtgctatccggactagcggggtgggagatacgcagtatttt

SEQ ID NO: 1207 - DNA, 51 bp, Homo sapiens
tgcagtgctattactccgggacaccgctctggggccaacgtcctgactttc

SEQ ID NO: 1208 - DNA, 42 bp, Homo sapiens
tgcagtgccctgggggacaggacgggatacgagcagtacttc

SEQ ID NO: 1209 - DNA, 45 bp, Homo sapiens
tgcagtgccctgggggaactagcgggagttggcgagcagttcttc

SEQ ID NO: 1210 - DNA, 42 bp, Homo sapiens
tgcagtgctctttccgggacgcctcacaatgagcagttcttc

SEQ ID NO: 1211 - DNA, 30 bp, Homo sapiens
tgcagtgccctcgttgggatccacaccttc

SEQ ID NO: 1212 - DNA, 36 bp, Homo sapiens
tgcagtgctaatcctcagggctatggctacaccttc

SEQ ID NO: 1213 - DNA, 45 bp, Homo sapiens
tgcagtgccaattcgggactagcgggaacaaatgagcagttcttc

SEQ ID NO: 1214 - DNA, 42 bp, Homo sapiens
tgcagtgctaactctatgagcgggagtgagacccagtacttc

SEQ ID NO: 1215 - DNA, 57 bp, Homo sapiens
tgcagtgctccagcctcactagcgtcccaacggggctcctacaatgagcagttcttc

SEQ ID NO: 1216 - DNA, 45 bp, Homo sapiens
tgcagtgccccgggagggacagatctaaatcagccccagcatttt

SEQ ID NO: 1217 - DNA, 45 bp, Homo sapiens
tgcagtgctcctcttatccgggagggacccggggagctgtttttt

SEQ ID NO: 1218 - DNA, 45 bp, Homo sapiens
tgcagtgctccgaacctaaacaggggggattacgagcagtacttc

SEQ ID NO: 1219 - DNA, 57 bp, Homo sapiens
tgcagtgctccgaacactgggggacaggggcgttggagcaatcagccccagcatttt

SEQ ID NO: 1220 - DNA, 39 bp, Homo sapiens
tgcagtgccccgaccggggatgccagcgagaagtacttc

SEQ ID NO: 1221 - DNA, 45 bp, Homo sapiens
tgcagtgccccctgggctagcgggagccggggaacgcagtatttt

SEQ ID NO: 1222 - DNA, 45 bp, Homo sapiens
tgcagtgctagagcccacggacatagtaatgaaaaactgtttttt

SEQ ID NO: 1223 - DNA, 42 bp, Homo sapiens
tgcagtgctagagcactagcgggagagtacgagcagtacttc

SEQ ID NO: 1224 - DNA, 42 bp, Homo sapiens
tgcagtgctagagccctaggggggggtcagccccaacatttt

SEQ ID NO: 1225 - DNA, 45 bp, Homo sapiens
tgcagtgctagagatgacgggactagccacaatgagcagttcttc

SEQ ID NO: 1226 - DNA, 45 bp, Homo sapiens
tgcagtgctagagatgataaggggccgggggatgagcagttcttc

SEQ ID NO: 1227 - DNA, 45 bp, Homo sapiens
tgcagtgctagagatgagggactcctgtcctacgagcagtacttc

SEQ ID NO: 1228 - DNA, 45 bp, Homo sapiens
tgcagtgctagagatgaggggagagactacaatgagcagttcttc

SEQ ID NO: 1229 - DNA, 54 bp, Homo sapiens
tgcagtgctagagatttcggcgggagaagggcctcctacaatgagcagttcttc

SEQ ID NO: 1230 - DNA, 42 bp, Homo sapiens
tgcagtgctagagatttcacctcgtccaatgagcagttcttc

SEQ ID NO: 1231 - DNA, 39 bp, Homo sapiens
tgcagtgctagagatgggatatacaatgagcagttcttc

SEQ ID NO: 1232 - DNA, 39 bp, Homo sapiens
tgcagtgctagagacggaaacaccggggagctgtttttt

SEQ ID NO: 1233 - DNA, 48 bp, Homo sapiens
tgcagtgctagagatgggagcgggatgaacaccggggagctgtttttt

SEQ ID NO: 1234 - DNA, 39 bp, Homo sapiens
tgcagtgctagggacgggacagggaatggctacaccttc

SEQ ID NO: 1235 - DNA, 48 bp, Homo sapiens
tgcagtgcaagagacgggacacattatagcaatcagccccagcatttt

SEQ ID NO: 1236 - DNA, 48 bp, Homo sapiens
tgcagtgctagagatcacctagcgggtgccttcaatgagcagttcttc

SEQ ID NO: 1237 - DNA, 45 bp, Homo sapiens
tgcagtgctagagatctcggggggtttaaagatacgcagtatttt

SEQ ID NO: 1238 - DNA, 39 bp, Homo sapiens
tgcagtgctagagatctggggaccggggagctgtttttt

SEQ ID NO: 1239 - DNA, 42 bp, Homo sapiens
tgcagtgctagagatcttggcactaatgaaaaactgtttttt

SEQ ID NO: 1240 - DNA, 45 bp, Homo sapiens
tgcagtgctagggacaacatagcaactaatgaaaaactgtttttt

SEQ ID NO: 1241 - DNA, 45 bp, Homo sapiens
tgcagtgctagagacccagcggcgaacaccggggagctgtttttt

SEQ ID NO: 1242 - DNA, 42 bp, Homo sapiens
tgcagtgctcgagaccccgacaggctctacgagcagtacttc

SEQ ID NO: 1243 - DNA, 54 bp, Homo sapiens
tgcagtgctagagatcccgggctagcgggaagggaatgggtgaggcagttcttc

SEQ ID NO: 1244 - DNA, 57 bp, Homo sapiens
tgcagtgctagagatccgactgcgacgggactagcggactacaatgagcagttcttc

SEQ ID NO: 1245 - DNA, 51 bp, Homo sapiens
tgcagtgctagagatccatatgcactagcgggaatctacgagcagtacttc

SEQ ID NO: 1246 - DNA, 45 bp, Homo sapiens
tgcagtgctagagaccagacagggatttttggtgaacagtacttc

SEQ ID NO: 1247 - DNA, 42 bp, Homo sapiens
tgcagtgctagagatagggaagggggagaggtagatacgcag

SEQ ID NO: 1248 - DNA, 42 bp, Homo sapiens
tgcagtgctagagacaggcctcactcctacgagcagtacttc

SEQ ID NO: 1249 - DNA, 42 bp, Homo sapiens
tgcagtgctagagatcggagggggcactatggctacaccttc

SEQ ID NO: 1250 - DNA, 45 bp, Homo sapiens
tgcagtgctagagatcgcaggcgtatcaatcagccccagcatttt

SEQ ID NO: 1251 - DNA, 39 bp, Homo sapiens
tgcagtgctagagatcggagctcctacgagcagtacttc

SEQ ID NO: 1252 - DNA, 42 bp, Homo sapiens
tgcagtgctagagatagcggggccgcctacgagcagtacttc

SEQ ID NO: 1253 - DNA, 45 bp, Homo sapiens
tgcagtgctagagataccccctcgggcaatcagccccagcatttt

SEQ ID NO: 1254 - DNA, 48 bp, Homo sapiens
tgcagtgctagagatgttctagcgggaaagatggagacccagtacttc

SEQ ID NO: 1255 - DNA, 42 bp, Homo sapiens
tgcagtgctagagattgggacagctcctacgagcagtacttc

SEQ ID NO: 1256 - DNA, 45 bp, Homo sapiens
tgcagtgctagagaaggggacagggatacggatacgcagtatttt

SEQ ID NO: 1257 - DNA, 39 bp, Homo sapiens
tgcagtgctagagagacagggtactacgagcagtacttc

SEQ ID NO: 1258 - DNA, 54 bp, Homo sapiens
tgcagtgctaggtttagcgggagggccacccagatgcaagagacccagtacttc

SEQ ID NO: 1259 - DNA, 45 bp, Homo sapiens
tgcagtgctcgaggggcggcttggtaccaagagacccagtacttc

SEQ ID NO: 1260 - DNA, 42 bp, Homo sapiens
tgcagtgctagaggagcgggagtacccaatgagcagttcttc

SEQ ID NO: 1261 - DNA, 37 bp, Homo sapiens
tgcagtgctagaggagggggtaattcacccctccact

SEQ ID NO: 1262 - DNA, 48 bp, Homo sapiens
tgcagtgctagagggggggttagcgggcgcacagatacgcagtatttt

SEQ ID NO: 1263 - DNA, 39 bp, Homo sapiens
tgcagtgctaggggtaagcgggactacgagcagtacttc

SEQ ID NO: 1264 - DNA, 45 bp, Homo sapiens
tgcagtgctagggggctccgggacgactcctacgagcagtacttc

SEQ ID NO: 1265 - DNA, 45 bp, Homo sapiens
tgcagtgctagaggcatggactatctctcctacgagcagtacttc

SEQ ID NO: 1266 - DNA, 42 bp, Homo sapiens
tgcagtgctaggggtcctagcgtttcctacgagcagtacttc

SEQ ID NO: 1267 - DNA, 45 bp, Homo sapiens
tgcagtgctagaggacagtgggctagctcctacgagcagtacttc

SEQ ID NO: 1268 - DNA, 39 bp, Homo sapiens
tgcagtgctagagggacagcggagtacgagcagtacttc

SEQ ID NO: 1269 - DNA, 42 bp, Homo sapiens
tgcagtgcaagacacacgagcttccaagagacccagtacttc

SEQ ID NO: 1270 - DNA, 42 bp, Homo sapiens
tgcagtgctagaatagcgggcgtcgcctacgagcagtacttc

SEQ ID NO: 1271 - DNA, 39 bp, Homo sapiens
tgcagtgctagaatccttttggagggtgaagctttcttt

SEQ ID NO: 1272 - DNA, 42 bp, Homo sapiens
tgcagtgctagaaagctgggtattgaggatacgcagtatttt

SEQ ID NO: 1273 - DNA, 42 bp, Homo sapiens
tgcagtgctagactagcgggagacaccggggagctgtttttt

SEQ ID NO: 1274 - DNA, 42 bp, Homo sapiens
tgcagtgctaggctcgagcggggggacaatgagcagttcttc

SEQ ID NO: 1275 - DNA, 39 bp, Homo sapiens
tgcagtgcccgtttgagggacacctacgagcagtacttc

SEQ ID NO: 1276 - DNA, 48 bp, Homo sapiens
tgcagtgcgagaatgggactagcgggagacaccggggagctgtttttt

SEQ ID NO: 1277 - DNA, 45 bp, Homo sapiens
tgcagtgcccgcaatggggagccggggcccaatgagcagttcttc

SEQ ID NO: 1278 - DNA, 45 bp, Homo sapiens
tgcagtgctagaaaccgggacggggcctacaatgagcagttcttc

SEQ ID NO: 1279 - DNA, 36 bp, Homo sapiens
tgcagtgcccggccggggggctacgagcagtacttc

SEQ ID NO: 1280 - DNA, 42 bp, Homo sapiens
tgcagtgctagacagggtttaggcaatcagccccagcatttt

SEQ ID NO: 1281 - DNA, 39 bp, Homo sapiens
tgcagtgcccgaagagcgggagcagatacgcagtatttt

SEQ ID NO: 1282 - DNA, 42 bp, Homo sapiens
tgcagtgctcgacgacagggatccgcttacgagcagtacttc

SEQ ID NO: 1283 - DNA, 36 bp, Homo sapiens
tgcagtgctaggagtaggacctacgagcagtacttc

SEQ ID NO: 1284 - DNA, 42 bp, Homo sapiens
tgcagtgccaggacccgactgatattggagccccagcatttt

SEQ ID NO: 1285 - DNA, 39 bp, Homo sapiens
tgcagtgcccggactagcggggataatgagcagttcttc

SEQ ID NO: 1286 - DNA, 48 bp, Homo sapiens
tgcagtgctagaaccagcgggagaggacttgggggcgagcagtacttc

SEQ ID NO: 1287 - DNA, 48 bp, Homo sapiens
tgcagtgcaaggactagcgggaggttaaatcccgatgagcagttcttc

SEQ ID NO: 1288 - DNA, 35 bp, Homo sapiens
tcgcaggggccggggagtcagatacgcagtatttt

SEQ ID NO: 1289 - DNA, 36 bp, Homo sapiens
tgcagtgctagagtcctggattacgagcagtacttc

SEQ ID NO: 1290 - DNA, 42 bp, Homo sapiens
tgcagtgctagagtaccgggacagaactacgagcagtacttc

SEQ ID NO: 1291 - DNA, 54 bp, Homo sapiens
tgcagtgctagagtccctccagagacagggacttacacctacgagcagtacttc

SEQ ID NO: 1292 - DNA, 39 bp, Homo sapiens
tgcagtgctagggtccgggaggcggagacccagtacttc

SEQ ID NO: 1293 - DNA, 45 bp, Homo sapiens
tgcagtgctagagttcgggagggcctcagcaatgagcagttcttc

SEQ ID NO: 1294 - DNA, 45 bp, Homo sapiens
tgcagtgctagtgcggacaggggttctggtcgcgagcagtacttc

SEQ ID NO: 1295 - DNA, 33 bp, Homo sapiens
tgcagtgctagcgccgggggtgagcagttcttc

SEQ ID NO: 1296 - DNA, 45 bp, Homo sapiens
tgcagtgctagtgcgggggggaccggtcatcatccccagcatttt

SEQ ID NO: 1297 - DNA, 45 bp, Homo sapiens
tgcagtgctagtgcgggggggaccggtcatcaaccccagtttttt

SEQ ID NO: 1298 - DNA, 45 bp, Homo sapiens
tgcagtgctagtgcgggggggaccggtcatcagccccagcatttt

SEQ ID NO: 1299 - DNA, 45 bp, Homo sapiens
tgcagtgctagtgcccgggacggatttacctacgagcagtacttc

SEQ ID NO: 1300 - DNA, 48 bp, Homo sapiens
tgcagtgctagtgatctagcgggagaaaccacagatacgcagtatttt

SEQ ID NO: 1301 - DNA, 45 bp, Homo sapiens
tgcagtgcttcgggggcagggataagctcctacgagcagtacttc

SEQ ID NO: 1302 - DNA, 48 bp, Homo sapiens
tgcagtgctagcggtggggcagggtcatccaaaaacattcagtacttc

SEQ ID NO: 1303 - DNA, 54 bp, Homo sapiens
tgcagtgctagtgggggactagcgggaggaagtacctacaatgagcagttcttc

SEQ ID NO: 1304 - DNA, 42 bp, Homo sapiens
tgcagtgctagcggactagcggactcctacgagcagtacttc

SEQ ID NO: 1305 - DNA, 36 bp, Homo sapiens
tgcagtgctagtgggagtcaagagacccagtacttc

SEQ ID NO: 1306 - DNA, 39 bp, Homo sapiens
tgcagtgcctccgggacaggggtttctggagctttcttt

SEQ ID NO: 1307 - DNA, 45 bp, Homo sapiens
tgcagtgctagtcatggatccgggttcacctacgagcagtacttc

SEQ ID NO: 1308 - DNA, 45 bp, Homo sapiens
tgcagtgcctcaaagtcgggctatccacccagtgagcagttcttc

SEQ ID NO: 1309 - DNA, 42 bp, Homo sapiens
tgcagtgctagcccaggggttggggacactgaagctttcttt

SEQ ID NO: 1310 - DNA, 51 bp, Homo sapiens
tgcagtgcatcccctaacgatgactggagggcgtttggtggctacaccttc

SEQ ID NO: 1311 - DNA, 45 bp, Homo sapiens
tgcagtgctagtcccagggaggggttgaacactgaagctttcttt

SEQ ID NO: 1312 - DNA, 42 bp, Homo sapiens
tgcagtgctagtccctggcgatcctacaatgagcagttcttc

SEQ ID NO: 1313 - DNA, 45 bp, Homo sapiens
tgcagtgctagcaggaaggtactcagcacagatacgcagtatttt

SEQ ID NO: 1314 - DNA, 48 bp, Homo sapiens
tgcagtgctagtagtgacagttactttagcaatcagccccagcatttt

SEQ ID NO: 1315 - DNA, 51 bp, Homo sapiens
tgcagtgctagtacaattgtgggactagcgggagcatatgagcagttcttc

SEQ ID NO: 1316 - DNA, 48 bp, Homo sapiens
tgcagtgcctcgaccccgactagcggggggacagatacccagtatttt

SEQ ID NO: 1317 - DNA, 48 bp, Homo sapiens
tgcagtgccagcacctcaccggtggggggcttagacgagcagtacttc

SEQ ID NO: 1318 - DNA, 61 bp, Homo sapiens
tgcagtgctacagaaaccgggactagcgggagttgggaagagcctgtggagacccagtact

SEQ ID NO: 1319 - DNA, 45 bp, Homo sapiens
tgcagtgctaccggggaaagctcctataattcacccctccacttt

SEQ ID NO: 1320 - DNA, 39 bp, Homo sapiens
tgcagtgccacagggactcttagcgatgagcagttcttc

SEQ ID NO: 1321 - DNA, 48 bp, Homo sapiens
tgcagtgctaccccgggggggccgagctcctacaatgagcagttcttc

SEQ ID NO: 1322 - DNA, 48 bp, Homo sapiens
tgcagtgcaacaccaacatcgacacaggtcccctacgagcagtacttc

SEQ ID NO: 1323 - DNA, 36 bp, Homo sapiens
tgcagtgctacccaacgatcctacgagcagtacttc

SEQ ID NO: 1324 - DNA, 45 bp, Homo sapiens
tgcagtgctacctccgggacgacgggggcctacgagcagtacttc

SEQ ID NO: 1325 - DNA, 51 bp, Homo sapiens
tgcagtgcaaccagccccttaggagccctagaggatagggagcagtacttc

SEQ ID NO: 1326 - DNA, 36 bp, Homo sapiens
tgcagtgcaacgactaagccccacgagcagtacttc

SEQ ID NO: 1327 - DNA, 39 bp, Homo sapiens
tgcagtgctgtgggcctgggggaagagacccagtacttc

SEQ ID NO: 1328 - DNA, 48 bp, Homo sapiens
tgcagtgcctggggccatcagggggccggacatgctgagcagttcttc

SEQ ID NO: 1329 - DNA, 51 bp, Homo sapiens
tgcagtgcgtggagagggacagggggccctactagtcgcgagcagttcttc

SEQ ID NO: 1330 - DNA, 48 bp, Homo sapiens
tgcagttgtgagggagagggactagcgggagggagcgagcagtacttc

SEQ ID NO: 1331 - DNA, 33 bp, Homo sapiens
tgcagtgaccccagcagagagacccagtacttc

SEQ ID NO: 1332 - DNA, 42 bp, Homo sapiens
tgcagtggagcggggaggcgtactcaagagacccagtacttc

SEQ ID NO: 1333 - DNA, 42 bp, Homo sapiens
tgcagtggaaggagccagggcctccgagagacccagtacttc

SEQ ID NO: 1334 - DNA, 39 bp, Homo sapiens
tgcagttccctgggacgaaactacaatgagcagttcttc

SEQ ID NO: 1335 - DNA, 39 bp, Homo sapiens
tgcagcacaccaggggcgggaggttcagagcagtacttc

SEQ ID NO: 1336 - DNA, 45 bp, Homo sapiens
tgcagtgtcttatcaccctcctcatttgtaaacattcagtacttc

SEQ ID NO: 1337 - DNA, 39 bp, Homo sapiens
tgcactaccaaggctaagcttcagggtgagcagttcttc

SEQ ID NO: 1338 - DNA, 51 bp, Homo sapiens
tgcgccagcagcttcaataattccaggtcgggggggcgaggctacaccttc

SEQ ID NO: 1339 - DNA, 48 bp, Homo sapiens
tgcgccagcagtcatccgggacagccgatcacctacgagcagtacttc

SEQ ID NO: 1340 - DNA, 45 bp, Homo sapiens
tgcgccagcagtcatcaggacagggggccaactgaagctttcttt

SEQ ID NO: 1341 - DNA, 48 bp, Homo sapiens
tgcgccagcagccctccgggggtacgagccaaaaacattcagtacttc

SEQ ID NO: 1342 - DNA, 48 bp, Homo sapiens
tgcgccagcagtcaacggacagaatctggggccaacgtcctgactttc

SEQ ID NO: 1343 - DNA, 60 bp, Homo sapiens
tgcgccagcagtcaatcgaccttcactagcgggagtcatactactggggagctgtttttt

SEQ ID NO: 1344 - DNA, 51 bp, Homo sapiens
tgtgccaccggtgatcccgaagggcagaaaaacaccggggagctgtttttt

SEQ ID NO: 1345 - DNA, 33 bp, Homo sapiens
tgtgccaccggtagtgggaacgagcagtacttc

SEQ ID NO: 1346 - DNA, 45 bp, Homo sapiens
tgtgccaccatatccagcgggagctcctacaatgagcagttcttc

SEQ ID NO: 1347 - DNA, 36 bp, Homo sapiens
tgtgccaccatggggacagggggtgaagctttcttt

SEQ ID NO: 1348 - DNA, 33 bp, Homo sapiens
tgtgccaccatgacagggaatgagcagttcttc

SEQ ID NO: 1349 - DNA, 48 bp, Homo sapiens
tgtgccaccaggacgatagcgggagacccctacaatgagcagttcttc

SEQ ID NO: 1350 - DNA, 36 bp, Homo sapiens
tgtgccaccagtgcgggggccggggagctgtttttt

SEQ ID NO: 1351 - DNA, 45 bp, Homo sapiens
tgtgccaccagtgccccgggggggtacggcgagacccagtacttc

SEQ ID NO: 1352 - DNA, 39 bp, Homo sapiens
tgtgccaccagtgatttcaggggagacgagcagttcttc

SEQ ID NO: 1353 - DNA, 48 bp, Homo sapiens
tgtgccaccagtgattttcggacaggggataccggggagctgtttttt

SEQ ID NO: 1354 - DNA, 45 bp, Homo sapiens
tgtgccaccagtgacctggacagtagacaagagacccagtacttc

SEQ ID NO: 1355 - DNA, 51 bp, Homo sapiens
tgtgccaccagtgatttgccggaggggtcgaatggaaacaccatatatttt

SEQ ID NO: 1356 - DNA, 42 bp, Homo sapiens
tgtgccaccagtgatttacagggagatcagccccagcatttt

SEQ ID NO: 1357 - DNA, 51 bp, Homo sapiens
tgtgccaccagtgatttgcagctagcgggaggttctgacgagctgtttttt

SEQ ID NO: 1358 - DNA, 42 bp, Homo sapiens
tgtgccaccagtgatttgtcgagcacagatacgcagtatttt

SEQ ID NO: 1359 - DNA, 48 bp, Homo sapiens
tgtgccaccagtgatctgacaggggctagcacagatacgcagtatttt

SEQ ID NO: 1360 - DNA, 45 bp, Homo sapiens
tgtgccaccagtgatttgacacccggagggactgaagctttcttt

SEQ ID NO: 1361 - DNA, 39 bp, Homo sapiens
tgtgccaccagtgatttgtggggtggtgagcagttcttc

SEQ ID NO: 1362 - DNA, 51 bp, Homo sapiens
tgtgccaccagtgatcccgaagggcagaaaaacaccggggagctgtttttt

SEQ ID NO: 1363 - DNA, 51 bp, Homo sapiens
tgtgccaccagtgatccaccccggggggcagacaccggggagctgtttttt

SEQ ID NO: 1364 - DNA, 42 bp, Homo sapiens
tgtgccaccagtgaccctagggcaggggtggtccagtacttc

SEQ ID NO: 1365 - DNA, 42 bp, Homo sapiens
tgtgccaccagtgacccatccgggggagttgagcagttcttc

SEQ ID NO: 1366 - DNA, 54 bp, Homo sapiens
tgtgccaccagtgatccctatctacccggccttgccaaaaacattcagtacttc

SEQ ID NO: 1367 - DNA, 45 bp, Homo sapiens
tgtgccaccagtgaccaacagggttcctacaatgagcagttcttc

SEQ ID NO: 1368 - DNA, 48 bp, Homo sapiens
tgtgccaccagtgaccagactagcggggttaccggggagctgtttttt

SEQ ID NO: 1369 - DNA, 45 bp, Homo sapiens
tgtgccacctccgatcggcggactagcacagatacgcagtatttt

SEQ ID NO: 1370 - DNA, 48 bp, Homo sapiens
tgtgccaccagtgattccggggggaggaaatacactgagcatttcttc

SEQ ID NO: 1371 - DNA, 51 bp, Homo sapiens
tgtgccaccagtgactcaggcatgagggagcccacagatacgcagtatttt

SEQ ID NO: 1372 - DNA, 42 bp, Homo sapiens
tgtgccaccagtgattcgcatcaaagccacgagcagtacttc

SEQ ID NO: 1373 - DNA, 48 bp, Homo sapiens
tgtgccaccagtgattctagcgggagagaatacaatgagcagttcttc

SEQ ID NO: 1374 - DNA, 45 bp, Homo sapiens
tgtgccaccagtgataccgagagcttgacaaatacccagtatttt

SEQ ID NO: 1375 - DNA, 45 bp, Homo sapiens
tgtgccaccagtgagggaagggggtacgtcggggagctgtttttt

SEQ ID NO: 1376 - DNA, 48 bp, Homo sapiens
tgtgccaccagtgaacgagaaatgggacagaccaatgagcagttcttc

SEQ ID NO: 1377 - DNA, 42 bp, Homo sapiens
tgtgccaccagtgaacggacagcgactcacgagcagtacttc

SEQ ID NO: 1378 - DNA, 45 bp, Homo sapiens
tgtgccaccagcttcaggacccctgagggaaatacgcagtatttt

SEQ ID NO: 1379 - DNA, 39 bp, Homo sapiens
tgtgccaccagtggggaggttgcgactgaagctttcttt

SEQ ID NO: 1380 - DNA, 48 bp, Homo sapiens
tgtgccaccagtcccggacagggggcggtcaccggggagctgtttttt

SEQ ID NO: 1381 - DNA, 42 bp, Homo sapiens
tgtgccaccaccgcgggggactataacaatgagcagttcttc

SEQ ID NO: 1382 - DNA, 39 bp, Homo sapiens
tgtgccagcgccgtagctgtgaacactgaagctttcttt

SEQ ID NO: 1383 - DNA, 36 bp, Homo sapiens
tgtgccagcgaactagccgtcggggagctgtttttt

SEQ ID NO: 1384 - DNA, 33 bp, Homo sapiens
tgtgccagcggacagggagtgaggcagtatttt

SEQ ID NO: 1385 - DNA, 39 bp, Homo sapiens
tgtgccagccggatggggtattccggggagctgtttttt

SEQ ID NO: 1386 - DNA, 42 bp, Homo sapiens
tgtgccagcagtgcccagggggagctctacgagcagtacttc

SEQ ID NO: 1387 - DNA, 39 bp, Homo sapiens
tgtgccagcagtgcgacagagtttgatgagcagttcttc

SEQ ID NO: 1388 - DNA, 48 bp, Homo sapiens
tgtgccagcagtgaggccgcgggaggggtaggagagacccagtacttc

SEQ ID NO: 1389 - DNA, 39 bp, Homo sapiens
tgtgccagcagtgagacagttgggcatggctacaccttc

SEQ ID NO: 1390 - DNA, 51 bp, Homo sapiens
tgtgccagcagtgaatacgaggacgcgagctcctacaatgagcagttcttc

SEQ ID NO: 1391 - DNA, 54 bp, Homo sapiens
tgtgccagcagtgaatataaggctccgaaagcacaagatgatacgcagtatttt

SEQ ID NO: 1392 - DNA, 45 bp, Homo sapiens
tgtgccagcagtgaatactcttggcgcacagatacgcagtatttt

SEQ ID NO: 1393 - DNA, 42 bp, Homo sapiens
tgtgccagcagttttagcgggagttacaatgagcagttcttc

SEQ ID NO: 1394 - DNA, 36 bp, Homo sapiens
tgtgccagcagtctagggggctacgagcagtacttc

SEQ ID NO: 1395 - DNA, 33 bp, Homo sapiens
tgtgccagcagtgtaggggacgagcagtacttc

SEQ ID NO: 1396 - DNA, 33 bp, Homo sapiens
tgtgccagtaccatgggggatgagcagttcttc

SEQ ID NO: 1397 - DNA, 33 bp, Homo sapiens
tgtgccagcaccccgggagatacgcagtatttt

SEQ ID NO: 1398 - DNA, 45 bp, Homo sapiens
tgtgccagccgactcttcttaggatgtcataatgagcagttcttc

SEQ ID NO: 1399 - DNA, 45 bp, Homo sapiens
tgtgccgccagaatacatccatctccatacaatgatcacttcttc

SEQ ID NO: 1400 - DNA, 42 bp, Homo sapiens
tgtgccgccagattacagggggcaaattacgaggagtacttc

SEQ ID NO: 1401 - DNA, 45 bp, Homo sapiens
tgtgcccagcaggggccgctcctgtggcacactgaagctttcttt

SEQ ID NO: 1402 - DNA, 51 bp, Homo sapiens
tgtgccagtgaaaggcgggaggcctccgtcgcctacaatgagcagttcttc

SEQ ID NO: 1403 - DNA, 42 bp, Homo sapiens
tgtgccagcttcccggggggggccgacactgaagctttcttt

SEQ ID NO: 1404 - DNA, 45 bp, Homo sapiens
tgtgccagcggccacggcctacctagcacagatacgcagtatttt

SEQ ID NO: 1405 - DNA, 39 bp, Homo sapiens
tgtgccagcgggttacgggcctctagtgagcagtacttc

SEQ ID NO: 1406 - DNA, 30 bp, Homo sapiens
tgtgccagcggctggaagctgcagtacttc

SEQ ID NO: 1407 - DNA, 36 bp, Homo sapiens
tgtgccagcaagacaggaacctacgagcagtacttc

SEQ ID NO: 1408 - DNA, 39 bp, Homo sapiens
tgtgccagcaaggtgggtcctccctacgagcagtacttc

SEQ ID NO: 1409 - DNA, 42 bp, Homo sapiens
tgtgccagcttaggaggtccccccggagagacccagtacttc

SEQ ID NO: 1410 - DNA, 42 bp, Homo sapiens
tgtgccagcaatctaggaacattcggggattcccgatatttt

SEQ ID NO: 1411 - DNA, 39 bp, Homo sapiens
tgtgccagcagggatcaagggggggacattcagtacttc

SEQ ID NO: 1412 - DNA, 39 bp, Homo sapiens
tgtgccagccgggacaggaccgacgaggggcagtacttc

SEQ ID NO: 1413 - DNA, 33 bp, Homo sapiens
tgtgccagcagggggggtggggagctgtttttt

SEQ ID NO: 1414 - DNA, 45 bp, Homo sapiens
tgtgccagcagaatacagccatctccatacaatgagcagttcttc

SEQ ID NO: 1415 - DNA, 39 bp, Homo sapiens
tgtgccagcagaaagacacgtcggtatggctacaccttc

SEQ ID NO: 1416 - DNA, 39 bp, Homo sapiens
tgtgccagccgactagcgggagtcaacgagcagtacttc

SEQ ID NO: 1417 - DNA, 42 bp, Homo sapiens
tgtgccagccggctcttagcgggagcctacgagcagtacttc

SEQ ID NO: 1418 - DNA, 39 bp, Homo sapiens
tgtgccagcagaaccgggagcctcggcgagcagtacttc

SEQ ID NO: 1419 - DNA, 39 bp, Homo sapiens
tgtgccagcaggacaggggtcgtgaatgagcagttcttc

SEQ ID NO: 1420 - DNA, 45 bp, Homo sapiens
tgtgccagcagaacatcgacatctccataccatgaccagttcttc

SEQ ID NO: 1421 - DNA, 45 bp, Homo sapiens
tgtgccagcagtgatggccaggtatcgaatcagccccagcatttt

SEQ ID NO: 1422 - DNA, 42 bp, Homo sapiens
tgtgccagcagtgaccgtccgggggtagatggctacaccttc

SEQ ID NO: 1423 - DNA, 39 bp, Homo sapiens
tgtgccagcagtttcggacagggatatggctacaccttc

SEQ ID NO: 1424 - DNA, 39 bp, Homo sapiens
tgtgccagcagttttgggagagggactgaagctttcttt

SEQ ID NO: 1425 - DNA, 45 bp, Homo sapiens
tgtgccagcagtttcgggactagcgtctcctacgagcagtacttc

SEQ ID NO: 1426 - DNA, 42 bp, Homo sapiens
tgtgccagcagttttttgggggataactatggctacaccttc

SEQ ID NO: 1427 - DNA, 45 bp, Homo sapiens
tgtgccagcagtttcccgggacagggttacaatgagcagttcttc

SEQ ID NO: 1428 - DNA, 39 bp, Homo sapiens
tgtgccagcagtttctccgacgacaatgagcagttcttc

SEQ ID NO: 1429 - DNA, 39 bp, Homo sapiens
tgtgccagcagtttcacaggggttcatgagcagttcttc

SEQ ID NO: 1430 - DNA, 48 bp, Homo sapiens
tgtgccagcagtttcactctcgggacaggggggaacgagcagtacttc

SEQ ID NO: 1431 - DNA, 42 bp, Homo sapiens
tgtgccagcagttttgtgacagggggccagccccagcatttt

SEQ ID NO: 1432 - DNA, 36 bp, Homo sapiens
tgtgccagctccggactagactacgagcagtacttc

SEQ ID NO: 1433 - DNA, 39 bp, Homo sapiens
tgtgccagcagtggctactcaggggacgagcagtacttc

SEQ ID NO: 1434 - DNA, 42 bp, Homo sapiens
tgtgccagcagccattggacaggggagtccgagcagtacttc

SEQ ID NO: 1435 - DNA, 48 bp, Homo sapiens
tgtgccagcagtatcgggacaggggggccacaagagacccagtacttc

SEQ ID NO: 1436 - DNA, 45 bp, Homo sapiens
tgtgccagcagcattaggaggggcgggggggagacccagtacttc

SEQ ID NO: 1437 - DNA, 42 bp, Homo sapiens
tgtgccagcagtattagcgggagggggaatgagcagttcttc

SEQ ID NO: 1438 - DNA, 39 bp, Homo sapiens
tgtgccagcagtttagcagggggctacgagcagtacttc

SEQ ID NO: 1439 - DNA, 48 bp, Homo sapiens
tgtgccagcagtctcgccggactagcgagatgggagacccagtacttc

SEQ ID NO: 1440 - DNA, 51 bp, Homo sapiens
tgtgccagcagtttagaggaagcgggagtcgcgaggaatgagcagttcttc

SEQ ID NO: 1441 - DNA, 45 bp, Homo sapiens
tgtgccagcagtttatttgcgggctcctacaatgagcagttcttc

SEQ ID NO: 1442 - DNA, 36 bp, Homo sapiens
tgtgccagcagtttattcgataatgagcagttcttc

SEQ ID NO: 1443 - DNA, 48 bp, Homo sapiens
tgtgccagcagtttatttggagcagggggggggaatgagcagttcttc

SEQ ID NO: 1444 - DNA, 39 bp, Homo sapiens
tgtgccagcagtttattcttgtccggggagctgtttttt

SEQ ID NO: 1445 - DNA, 39 bp, Homo sapiens
tgtgccagcagtttattcaggggttatgagcagttcttc

SEQ ID NO: 1446 - DNA, 66 bp, Homo sapiens
tgtgccagcagtttattttctccaggagtgggtactagcgttggaaggggagatacgcagtatttt

SEQ ID NO: 1447 - DNA, 45 bp, Homo sapiens
tgtgccagcagtttaggggccctttatgaaaacattcattacttc

SEQ ID NO: 1448 - DNA, 39 bp, Homo sapiens
tgtgccagcagtttaggggccaccggggagctgtttttt

SEQ ID NO: 1449 - DNA, 39 bp, Homo sapiens
tgtgccagcagtttaggcttcacagatacgcagtatttt

SEQ ID NO: 1450 - DNA, 39 bp, Homo sapiens
tgtgccagcagtttagggtcagtgacggagcagtacttc

SEQ ID NO: 1451 - DNA, 42 bp, Homo sapiens
tgtgccagcagtttgattagcgggaactacgagcagtacttc

SEQ ID NO: 1452 - DNA, 45 bp, Homo sapiens
tgtgccagcagtttaaaggacaggggatcctacgagcagtacttc

SEQ ID NO: 1453 - DNA, 54 bp, Homo sapiens
tgtgccagcagtttgctctctttcggcgggagggccggagatgagcagttcttc

SEQ ID NO: 1454 - DNA, 54 bp, Homo sapiens
tgtgccagcagtttgctctctttcggcgggagggccggaaatgagcagttcttc

SEQ ID NO: 1455 - DNA, 39 bp, Homo sapiens
tgtgccagcagtttaaaccgaaaagagacccagtacttc

SEQ ID NO: 1456 - DNA, 39 bp, Homo sapiens
tgtgccagcagtttgcaggctaatcagccccagcatttt

SEQ ID NO: 1457 - DNA, 45 bp, Homo sapiens
tgtgccagcagtctccagggggacaccacctacgagcagtacttc

SEQ ID NO: 1458 - DNA, 45 bp, Homo sapiens
tgtgccagcagtttaagagctccctcctcctacgagcagtacttc

SEQ ID NO: 1459 - DNA, 39 bp, Homo sapiens
tgtgccagcagtttaagggaatcgtacgagcagtacttc

SEQ ID NO: 1460 - DNA, 42 bp, Homo sapiens
tgtgccagcagtttaagaggggccacagatacgcagtatttt

SEQ ID NO: 1461 - DNA, 39 bp, Homo sapiens
tgtgccagcagtttatcggcagggggcggctacaccttc

SEQ ID NO: 1462 - DNA, 48 bp, Homo sapiens
tgtgccagcagtttatccgacagggggcgcagcaatgagcagttcttc

SEQ ID NO: 1463 - DNA, 39 bp, Homo sapiens
tgtgccagcagtttgtctggggccaacgtcctgactttc

SEQ ID NO: 1464 - DNA, 42 bp, Homo sapiens
tgtgccagcagcctaagcgggggcacctacgagcagtacttc

SEQ ID NO: 1465 - DNA, 48 bp, Homo sapiens
tgtgccagcagtttaagtcttggtctagcgggaattgagcagttcttc

SEQ ID NO: 1466 - DNA, 48 bp, Homo sapiens
tgtgccagcagtttatcccttttagggaatgacaatgagcagttcttc

SEQ ID NO: 1467 - DNA, 48 bp, Homo sapiens
tgtgccagcagtttatcgcctagcgggagttcaaatacgcagtatttt

SEQ ID NO: 1468 - DNA, 45 bp, Homo sapiens
tgtgccagcagtttaagcaggggactcctcaatgagcagttcttc

SEQ ID NO: 1469 - DNA, 45 bp, Homo sapiens
tgtgccagcagtttatcgaggggctccctctacgagcagtacttc

SEQ ID NO: 1470 - DNA, 45 bp, Homo sapiens
tgtgccagcagtttatcaaggacagggtctagtgaagctttcttt

SEQ ID NO: 1471 - DNA, 42 bp, Homo sapiens
tgtgccagcagtttaagctctcccctcaatgagcagttcttc

SEQ ID NO: 1472 - DNA, 48 bp, Homo sapiens
tgtgccagcagtttatcctgggggtcaccccaaaatgagcagttcttc

SEQ ID NO: 1473 - DNA, 42 bp, Homo sapiens
tgtgccagcagtctcaccctaggagggtacgagcagttcttc

SEQ ID NO: 1474 - DNA, 42 bp, Homo sapiens
tgtgccagcagtttaactagcgggacatacgagcagtacttc

SEQ ID NO: 1475 - DNA, 48 bp, Homo sapiens
tgtgccagcagtttagttagcctagcgggagagtacgagcagtacttc

SEQ ID NO: 1476 - DNA, 45 bp, Homo sapiens
tgtgccagcagtttatgggacggaaccatggatacgcagtatttt

SEQ ID NO: 1477 - DNA, 45 bp, Homo sapiens
tgtgccagcagtttatggggggctggggccaacgtcctgactttc

SEQ ID NO: 1478 - DNA, 39 bp, Homo sapiens
tgtgccagcagtttatacccacagggaaaactgtttttt

SEQ ID NO: 1479 - DNA, 45 bp, Homo sapiens
tgtgccagcagtctatactcagggggctcaggcgagcagtacttc

SEQ ID NO: 1480 - DNA, 45 bp, Homo sapiens
tgtgccagcagccctgacagtcttctctacaatgagcagttcttc

SEQ ID NO: 1481 - DNA, 39 bp, Homo sapiens
tgtgccagcagcccattcttgtccggcgagctgtatttt

SEQ ID NO: 1482 - DNA, 48 bp, Homo sapiens
tgtgccagcagccctggggctagcgggagttacaatgagcagttcttc

SEQ ID NO: 1483 - DNA, 42 bp, Homo sapiens
tgtgccagcagtccgggacagggaggctacgagcagtacttc

SEQ ID NO: 1484 - DNA, 39 bp, Homo sapiens
tgtgccagcagtcccgggactgccgccgagcagtacttc

SEQ ID NO: 1485 - DNA, 48 bp, Homo sapiens
tgtgccagcagtccggggacagggggctactacaatgagcagttcttc

SEQ ID NO: 1486 - DNA, 48 bp, Homo sapiens
tgtgccagcagccccgggacgattgactctggaaacaccatatatttt

SEQ ID NO: 1487 - DNA, 48 bp, Homo sapiens
tgtgccagcagtccccacccgacagggtctgcagatacgcagtatttt

SEQ ID NO: 1488 - DNA, 45 bp, Homo sapiens
tgtgccagcagtcccctcgagacagcgggagatggctacaccttc

SEQ ID NO: 1489 - DNA, 45 bp, Homo sapiens
tgtgccagcagtcccctcaagacggcgggagatggctacaccttc

SEQ ID NO: 1490 - DNA, 36 bp, Homo sapiens
tgtgccagcagcccaccggggaagacgcagtatttt

SEQ ID NO: 1491 - DNA, 49 bp, Homo sapiens
vtgtgccagcagtccccggggagcgggagggccctacgagcagtacttc

SEQ ID NO: 1492 - DNA, 51 bp, Homo sapiens
tgtgccagcagtccaagggttccgggacaagtcaattcacccctccacttt

SEQ ID NO: 1493 - DNA, 42 bp, Homo sapiens
tgtgccagcagtccatcgacaggggcccctgaagctttcttt

SEQ ID NO: 1494 - DNA, 45 bp, Homo sapiens
tgtgccagcagtccctcgacagggggcagtcagccccagcatttt

SEQ ID NO: 1495 - DNA, 45 bp, Homo sapiens
tgtgccagcagtcccaccgcagggggccgaaacgagcagtacttc

SEQ ID NO: 1496 - DNA, 36 bp, Homo sapiens
tgtgccagcagtccctacaccggggagctgtttttt

SEQ ID NO: 1497 - DNA, 45 bp, Homo sapiens
tgtgccagcagtcagacctccgggacagcatacgagcagtacttc

SEQ ID NO: 1498 - DNA, 39 bp, Homo sapiens
tgtgccagcagtagagcggcaaactatggctacaccttc

SEQ ID NO: 1499 - DNA, 42 bp, Homo sapiens
tgtgccagcagtcgagcggatccccaagagacccagtacttc

SEQ ID NO: 1500 - DNA, 39 bp, Homo sapiens
tgtgccagcagtcgaggggagtccggggagctgtttttt

SEQ ID NO: 1501 - DNA, 42 bp, Homo sapiens
tgtgccagcagccgacagggggatacctacgagcagtacttc

SEQ ID NO: 1502 - DNA, 48 bp, Homo sapiens
tgtgccagcagttcagatgctagctggggaacagatacgcagtatttt

SEQ ID NO: 1503 - DNA, 45 bp, Homo sapiens
tgtgccagcagttcagagggacaggcgacctacgagcagtacttc

SEQ ID NO: 1504 - DNA, 39 bp, Homo sapiens
tgtgccagcagttctttcgacagctatggctacaccttc

SEQ ID NO: 1505 - DNA, 39 bp, Homo sapiens
tgtgccagcagttccggtggcctcaatgagcagttcttc

SEQ ID NO: 1506 - DNA, 39 bp, Homo sapiens
tgtgccagcagttccggcaggttcactgaagctttcttt

SEQ ID NO: 1507 - DNA, 39 bp, Homo sapiens
tgtgccagcagttccctccctttatatgaagctttcttt

SEQ ID NO: 1508 - DNA, 57 bp, Homo sapiens
tgtgccagcagttcccaggacccgggactagcgggagtttacaatgagcagttcttc

SEQ ID NO: 1509 - DNA, 45 bp, Homo sapiens
tgtgccagcagttcaaccggacagggaaatcagccccagcatttt

SEQ ID NO: 1510 - DNA, 48 bp, Homo sapiens
tgtgccagcagttcctgggatagcggaagctcctacgagcagtacttc

SEQ ID NO: 1511 - DNA, 39 bp, Homo sapiens
tgtgccagcagttcatgggactcctacgagcagtacttc

SEQ ID NO: 1512 - DNA, 45 bp, Homo sapiens
tgtgccagcagttcatacaggggaggtccctacgagcagtacttc

SEQ ID NO: 1513 - DNA, 36 bp, Homo sapiens
tgtgccagcagtacaggactgtatggctacaccttc

SEQ ID NO: 1514 - DNA, 42 bp, Homo sapiens
tgtgccagcagtaccgggatgaacaccggggagctgtttttt

SEQ ID NO: 1515 - DNA, 60 bp, Homo sapiens
tgtgccagcagtacccacaggggggggaatagcgtggatggcaatcagccccagcatttt

SEQ ID NO: 1516 - DNA, 51 bp, Homo sapiens
tgtgccagcagtgtaagacgggggccaaaaaacaccggggagctgtttttt

SEQ ID NO: 1517 - DNA, 45 bp, Homo sapiens
tgtgccagcagttgggacaggggaggttctcagccccagcatttt

SEQ ID NO: 1518 - DNA, 42 bp, Homo sapiens
tgtgccagcagttggggtaggggcaccggggagctgtttttt

SEQ ID NO: 1519 - DNA, 45 bp, Homo sapiens
tgtgccagcagttggcagaaacggggcacagatacgcagtatttt

SEQ ID NO: 1520 - DNA, 45 bp, Homo sapiens
tgtgccagcagctggactagcgggagggtagatgagcagttcttc

SEQ ID NO: 1521 - DNA, 39 bp, Homo sapiens
tgtgccagcagttactttcgcgggaatgagcagttcttc

SEQ ID NO: 1522 - DNA, 39 bp, Homo sapiens
tgtgccagcagttaccttaagggtaccgagcagtacttc

SEQ ID NO: 1523 - DNA, 33 bp, Homo sapiens
tgtgccagcactgacgccggggagctgtttttt

SEQ ID NO: 1524 - DNA, 36 bp, Homo sapiens
tgtgccagcaccggaggcacagatacgcagtatttt

SEQ ID NO: 1525 - DNA, 39 bp, Homo sapiens
tgtgccagcacaagcggggggaccggggagctgtttttt

SEQ ID NO: 1526 - DNA, 45 bp, Homo sapiens
tgtgccaccagaatacagccatctccatacaatgagcacttcttc

SEQ ID NO: 1527 - DNA, 39 bp, Homo sapiens
tgtgccaccaggacaggggtcgtgaatgagcatttcttc

SEQ ID NO: 1528 - DNA, 48 bp, Homo sapiens
tgtgccaccagtccggggacagggggctactacaatgaccagttcttc

SEQ ID NO: 1529 - DNA, 36 bp, Homo sapiens
tgtgcctgctgttttggcggacctgaacctttcttt

SEQ ID NO: 1530 - DNA, 33 bp, Homo sapiens
tgtgcctgcttctggggcgggcagctgtttttt

SEQ ID NO: 1531 - DNA, 45 bp, Homo sapiens
tgtgcctgccagcctccggaaggtctctcagagacccagtacttc

SEQ ID NO: 1532 - DNA, 39 bp, Homo sapiens
tgtgccatcaggactagcggcacagatacgcagtatttt

SEQ ID NO: 1533 - DNA, 39 bp, Homo sapiens
tgtgccaataaacagcgggaccgttaccagcagaacttc

SEQ ID NO: 1534 - DNA, 36 bp, Homo sapiens
tgtgccagcgcctcaaactacaatgagcagttcttc

SEQ ID NO: 1535 - DNA, 39 bp, Homo sapiens
tgtgccagcgaggggccggagaacactgaagctttcttt

SEQ ID NO: 1536 - DNA, 48 bp, Homo sapiens
tgtgccagctttacccgcgtggcagcctctggaaacaccatatatttt

SEQ ID NO: 1537 - DNA, 54 bp, Homo sapiens
tgtgccagcggttccggggaacctcctgtggtgggggactacgagcagtacttc

SEQ ID NO: 1538 - DNA, 45 bp, Homo sapiens
tgtgccagcaagctgggacggcaggggattgagacccagtacttc

SEQ ID NO: 1539 - DNA, 48 bp, Homo sapiens
tgtgccagcaagcaagcgggaggaatcggcacagatacgcagtatttt

SEQ ID NO: 1540 - DNA, 54 bp, Homo sapiens
tgtgccagtttggcgttggggtggcggactagcggtaccaatgagcagttcttc

SEQ ID NO: 1541 - DNA, 39 bp, Homo sapiens
tgtgccagcatggctagcgggaaggatgagcagttcttc

SEQ ID NO: 1542 - DNA, 42 bp, Homo sapiens
tgtgccagcaatagaggacagtcctttggggagcagtacttc

SEQ ID NO: 1543 - DNA, 42 bp, Homo sapiens
tgtgccagccaatccgggactagcggagacgagcagtacttc

SEQ ID NO: 1544 - DNA, 42 bp, Homo sapiens
tgtgccagcagggctacagggtctggaaacaccatatatttt

SEQ ID NO: 1545 - DNA, 45 bp, Homo sapiens
tgtgccagcaggggaaccgggacagccatccacgagcagtacttc

SEQ ID NO: 1546 - DNA, 45 bp, Homo sapiens
tgtgccagcaggattgacagggccagctcctacgagcagtacttc

SEQ ID NO: 1547 - DNA, 42 bp, Homo sapiens
tgtgccagcagaatcgacagctcctacaatgagcagttcttc

SEQ ID NO: 1548 - DNA, 42 bp, Homo sapiens
tgtgccagcagaccaccccagggcggctatggctacaccttc

SEQ ID NO: 1549 - DNA, 48 bp, Homo sapiens
tgtgccagcaggaggatggacaggcagattgctgagacccagtacttc

SEQ ID NO: 1550 - DNA, 39 bp, Homo sapiens
tgtgccagcaggtcctcgggtatggatgagcagttcttc

SEQ ID NO: 1551 - DNA, 45 bp, Homo sapiens
tgtgccagcagaacacagcgggaggcaaacaatgagcagttcttc

SEQ ID NO: 1552 - DNA, 45 bp, Homo sapiens
tgtgccagccgctacttccgggacagggccggggagctgtttttt

SEQ ID NO: 1553 - DNA, 54 bp, Homo sapiens
tgtgccagcagtgaaaggaaacgggacaaactacacacagatacgcagtatttt

SEQ ID NO: 1554 - DNA, 42 bp, Homo sapiens
tgtgccagcagtttcgacagcttgaacactgaagctttcttt

SEQ ID NO: 1555 - DNA, 45 bp, Homo sapiens
tgtgccagcagtttttttggacagggggccaacgagcagtacttc

SEQ ID NO: 1556 - DNA, 33 bp, Homo sapiens
tgtgccagcagttttggaggggagcagttcttc

SEQ ID NO: 1557 - DNA, 42 bp, Homo sapiens
tgtgccagcagttttggcatcctgacctacgagcagtacttc

SEQ ID NO: 1558 - DNA, 48 bp, Homo sapiens
tgtgccagcagtttcttagcgggagggtcaggcaatgagcagttcttc

SEQ ID NO: 1559 - DNA, 42 bp, Homo sapiens
tgtgccagcagttttaattcagggaactatggctacaccttc

SEQ ID NO: 1560 - DNA, 54 bp, Homo sapiens
tgtgccagcagtttccagggacagggggcacttttcgcctacgagcagtacttc

SEQ ID NO: 1561 - DNA, 45 bp, Homo sapiens
tgtgccagcagtttccaaacagggggcgggactgaagctttcttt

SEQ ID NO: 1562 - DNA, 45 bp, Homo sapiens
tgtgccagcagtttttcgcgtacgcgcacagatacgcagtatttt

SEQ ID NO: 1563 - DNA, 42 bp, Homo sapiens
tgtgccagcagtttctggcgctcggggaatgagcagttcttc

SEQ ID NO: 1564 - DNA, 39 bp, Homo sapiens
tgtgccagttccgggacagggggctacgagcagtacttc

SEQ ID NO: 1565 - DNA, 45 bp, Homo sapiens
tgtgccagcagtatagacagggaagtgcgctacgagcagtacttc

SEQ ID NO: 1566 - DNA, 30 bp, Homo sapiens
tgtgccagcagtatagaagagcagttcttc

SEQ ID NO: 1567 - DNA, 39 bp, Homo sapiens
tgtgccagcagtttagctcgccagaacgagcagtacttc

SEQ ID NO: 1568 - DNA, 45 bp, Homo sapiens
tgtgccagcagtctggacagggcccgaaaagagacccagtacttc

SEQ ID NO: 1569 - DNA, 39 bp, Homo sapiens
tgtgccagcagtttagagccattggatggctacaccttc

SEQ ID NO: 1570 - DNA, 39 bp, Homo sapiens
tgtgccagcagtctggaggtgtggggggagctgtttttt

SEQ ID NO: 1571 - DNA, 45 bp, Homo sapiens
tgtgccagcagtttagggatagcgggaggctatgagcagttcttc

SEQ ID NO: 1572 - DNA, 36 bp, Homo sapiens
tgtgccagcagtttaggccgagagacccagtacttc

SEQ ID NO: 1573 - DNA, 45 bp, Homo sapiens
tgtgccagcagtttagggacagggacgtacaatgagcagttcttc

SEQ ID NO: 1574 - DNA, 39 bp, Homo sapiens
tgtgccagcagtttaggctattcctacgagcagtacttc

SEQ ID NO: 1575 - DNA, 45 bp, Homo sapiens
tgtgccagcagtcttaaaaagggagaaatctacgagcagtacttc

SEQ ID NO: 1576 - DNA, 36 bp, Homo sapiens
tgtgccagcagtttgctagacctcgagcagtacttc

SEQ ID NO: 1577 - DNA, 48 bp, Homo sapiens
tgtgccagcagtttgttgggtagggctgtgtcctacgagcagtacttc

SEQ ID NO: 1578 - DNA, 51 bp, Homo sapiens
tgtgccagcagtttactacatagcgcctctggggccaacgtcctgactttc

SEQ ID NO: 1579 - DNA, 48 bp, Homo sapiens
tgtgccagcagtttactaagggaccagcgggggtacgagcagtacttc

SEQ ID NO: 1580 - DNA, 39 bp, Homo sapiens
tgtgccagcagtttaaacatggtctatggctacaccttc

SEQ ID NO: 1581 - DNA, 36 bp, Homo sapiens
tgtgccagcagtctgaacaccggggagctgtttttt

SEQ ID NO: 1582 - DNA, 33 bp, Homo sapiens
tgtgccagcagtttaccgggaagctacaccttc

SEQ ID NO: 1583 - DNA, 45 bp, Homo sapiens
tgtgccagcagcctccaagggacagggtggactgaagctttcttt

SEQ ID NO: 1584 - DNA, 42 bp, Homo sapiens
tgtgccagcagtttacaggggtacccctacgagcagtacttc

SEQ ID NO: 1585 - DNA, 42 bp, Homo sapiens
tgtgccagcagtttatctatggggtcagatacgcagtatttt

SEQ ID NO: 1586 - DNA, 33 bp, Homo sapiens
tgtgccagcagtttaacagatacgcagtatttt

SEQ ID NO: 1587 - DNA, 54 bp, Homo sapiens
tgtgccagcagtttaactagcgggggatactctagcacagatacgcagtatttt

SEQ ID NO: 1588 - DNA, 45 bp, Homo sapiens
tgtgccagcagtttagtggcgggagaaccttacgagcagtacttc

SEQ ID NO: 1589 - DNA, 39 bp, Homo sapiens
tgtgccagcagtttagtcttggtttacgagcagtacttc

SEQ ID NO: 1590 - DNA, 42 bp, Homo sapiens
tgtgccagcagtttatggggcagcacagatacgcagtatttt

SEQ ID NO: 1591 - DNA, 42 bp, Homo sapiens
tgtgccagcagtttatgggggacactatacgagcagtacttc

SEQ ID NO: 1592 - DNA, 42 bp, Homo sapiens
tgtgccagcagtatgacagggaccttcaatgagcagttcttc

SEQ ID NO: 1593 - DNA, 45 bp, Homo sapiens
tgtgccagcagtccagggatcgacctcaatcagccccagcatttt

SEQ ID NO: 1594 - DNA, 39 bp, Homo sapiens
tgtgccagcagcccgggactagcgaccgagcagtacttc

SEQ ID NO: 1595 - DNA, 51 bp, Homo sapiens
tgtgccagcagccccatgggggggctagcgggagtctacgagcagtacttc

SEQ ID NO: 1596 - DNA, 45 bp, Homo sapiens
tgtgccagcagcccacccggagggggtaattcacccctccacttt

SEQ ID NO: 1597 - DNA, 51 bp, Homo sapiens
tgtgccagcagtccacccgggacaggggttctaggcactgaagctttcttt

SEQ ID NO: 1598 - DNA, 42 bp, Homo sapiens
tgtgccagcagtcccagagggacattctatggctacaccttc

SEQ ID NO: 1599 - DNA, 45 bp, Homo sapiens
tgtgccagcagtccctccgggacagggttggagacccagtacttc

SEQ ID NO: 1600 - DNA, 39 bp, Homo sapiens
tgtgccagcagtccgacagggtctttcgagcagtacttc

SEQ ID NO: 1601 - DNA, 42 bp, Homo sapiens
tgtgccagcagccctaccgggacaaaaaatggctacaccttc

SEQ ID NO: 1602 - DNA, 42 bp, Homo sapiens
tgtgccagcagccagacaggggcggcctacgagcagtacttc

SEQ ID NO: 1603 - DNA, 45 bp, Homo sapiens
tgtgccagcagccgcgggggagaggacaccggggagctgtttttt

SEQ ID NO: 1604 - DNA, 42 bp, Homo sapiens
tgtgccagcagcagaatagcggatatgaatgagcagttcttc

SEQ ID NO: 1605 - DNA, 45 bp, Homo sapiens
tgtgccagcagcagattgcgggaacggggagagacccagtacttc

SEQ ID NO: 1606 - DNA, 45 bp, Homo sapiens
tgtgccagcagctcggacagggtaaggaatcagccccagcatttt

SEQ ID NO: 1607 - DNA, 42 bp, Homo sapiens
tgtgccagcagttcaatagggacagcctacgagcagtacttc

SEQ ID NO: 1608 - DNA, 48 bp, Homo sapiens
tgtgccagcagttcctccgggacacaaaacacagatacgcagtatttt

SEQ ID NO: 1609 - DNA, 42 bp, Homo sapiens
tgtgccagcagctcgacagggttttccgaaaaactgtttttt

SEQ ID NO: 1610 - DNA, 48 bp, Homo sapiens
tgtgccagcagttcctggactagcggagacacagatacgcagtatttt

SEQ ID NO: 1611 - DNA, 36 bp, Homo sapiens
tgtgccagcagtacggtccagaatgagcagttcttc

SEQ ID NO: 1612 - DNA, 45 bp, Homo sapiens
tgtgccagcagttgggacttcagctcctacaatgagcagttcttc

SEQ ID NO: 1613 - DNA, 36 bp, Homo sapiens
tgtgccagcagttgggggggaaaggagcagtacttc

SEQ ID NO: 1614 - DNA, 39 bp, Homo sapiens
tgtgccagcagttggggacaggtttccgagcagtacttc

SEQ ID NO: 1615 - DNA, 42 bp, Homo sapiens
tgtgccagcagttatctagcgggagcctacgagcagtacttc

SEQ ID NO: 1616 - DNA, 45 bp, Homo sapiens
tgtgccagcaccgatggactagcgggagcctacgagcagtacttc

SEQ ID NO: 1617 - DNA, 39 bp, Homo sapiens
tgtgccagcacgataacagagaacactgaagctttcttt

SEQ ID NO: 1618 - DNA, 48 bp, Homo sapiens
tgtgccagcaccttgggcctagcgggacccccctacgagcagtacttc

SEQ ID NO: 1619 - DNA, 45 bp, Homo sapiens
tgtgccaccaggttcatggcgggtccaacccacgagcagtacttc

SEQ ID NO: 1620 - DNA, 51 bp, Homo sapiens; identical to SEQ ID NO: 1362

SEQ ID NO: 1621 - DNA, 45 bp, Homo sapiens
tgtgccaccagtcgtagcgggagcttgacagatacgcagtatttt

SEQ ID NO: 1622 - DNA, 42 bp, Homo sapiens
tgcagcgctgggacaggtggcactaatgaaaaactgtttttt

SEQ ID NO: 1623 - DNA, 39 bp, Homo sapiens
tgcagcgcccgacaggggagcgcctacgagcagtacttc

SEQ ID NO: 1624 - DNA, 51 bp, Homo sapiens
tgcagcggggagggcaggtcgactagcggggggttcgatgagcagttcttc

SEQ ID NO: 1625 - DNA, 45 bp, Homo sapiens
tgcagcacaagactagcgggagagcgccaagagacccagtacttc

SEQ ID NO: 1626 - DNA, 45 bp, Homo sapiens
tgcagcgtcgctgactctattggagccaaaaacattcagtacttc

SEQ ID NO: 1627 - DNA, 39 bp, Homo sapiens
tgcagcgtcgctagcgggaccggctacgagcagtacttc

SEQ ID NO: 1628 - DNA, 45 bp, Homo sapiens
tgcagcgttgatccgacgggtcggggccaagagacccagtacttc

SEQ ID NO: 1629 - DNA, 36 bp, Homo sapiens
tgcagcgtggacaggggcgaaaacattcagtacttc

SEQ ID NO: 1630 - DNA, 33 bp, Homo sapiens
tgcagcgtagacaggaacactgaagctttcttt

SEQ ID NO: 1631 - DNA, 42 bp, Homo sapiens
tgcagcgttgattctaggggctcctacaatgagcagttcttc

SEQ ID NO: 1632 - DNA, 42 bp, Homo sapiens
tgcagcgttgacgtccagggccggacagatacgcagtatttt

SEQ ID NO: 1633 - DNA, 33 bp, Homo sapiens
tgcagcgttgaagcagtcaggaccctgttcttc

SEQ ID NO: 1634 - DNA, 48 bp, Homo sapiens
tgcagcgttgaagcgtgggagcgggggaacaccggggagctgtttttt

SEQ ID NO: 1635 - DNA, 48 bp, Homo sapiens
tgcagcgttgaagatggaggagggtcgaacaccggggagctgtttttt

SEQ ID NO: 1636 - DNA, 45 bp, Homo sapiens
tgcagcgttgaagaccccctagcggaagtagagacccagtacttc

SEQ ID NO: 1637 - DNA, 42 bp, Homo sapiens
tgcagcgttgaagatccacaggggaactatggctacaccttc

SEQ ID NO: 1638 - DNA, 51 bp, Homo sapiens
tgcagcgttgaagactgggatagcggaaccgccgcagatacgcagtatttt

SEQ ID NO: 1639 - DNA, 36 bp, Homo sapiens
tgcagcgttgaagaaacaaactacgagcagtacttc

SEQ ID NO: 1640 - DNA, 30 bp, Homo sapiens
tgcagcgtcgagggggaggagcagttcttc

SEQ ID NO: 1641 - DNA, 42 bp, Homo sapiens
tgcagcgttgaaggaaatgggggggccaacgtcctgactttc

SEQ ID NO: 1642 - DNA, 39 bp, Homo sapiens
tgcagcgttgaggggcgcctaggaaacaccatatatttt

SEQ ID NO: 1643 - DNA, 45 bp, Homo sapiens
tgcagcgttgaaggtagcgggagaacctacaatgagcagttcttc

SEQ ID NO: 1644 - DNA, 51 bp, Homo sapiens
tgcagcgttgaagggacggtggacagggaagcgtgggagacccagtacttc

SEQ ID NO: 1645 - DNA, 33 bp, Homo sapiens
tgcagcgttgaactattcaacgagcagtacttc

SEQ ID NO: 1646 - DNA, 39 bp, Homo sapiens
tgcagcgttgaattagggggggcctacgagcagtacttc

SEQ ID NO: 1647 - DNA, 42 bp, Homo sapiens
tgcagcgttgaaactagcgggaggttcaatgagcagttcttc

SEQ ID NO: 1648 - DNA, 42 bp, Homo sapiens
tgcagcgttgaggtggcggggggcggggagacccagtacttc

SEQ ID NO: 1649 - DNA, 39 bp, Homo sapiens
tgcagcgttgaagttttgggtaactatggctacaccttc

SEQ ID NO: 1650 - DNA, 48 bp, Homo sapiens
tgcagcgttgaatggtctgaggggcactcctacaatgagcagttcttc

SEQ ID NO: 1651 - DNA, 42 bp, Homo sapiens
tgcagcgttggagctgggggcactaatgaaaaactgtttttt

SEQ ID NO: 1652 - DNA, 42 bp, Homo sapiens
tgcagcgttggatttaggggaaccggatacgagcagtacttc

SEQ ID NO: 1653 - DNA, 36 bp, Homo sapiens
tgcagcgttggggggtcgttctatggctacaccttc

SEQ ID NO: 1654 - DNA, 36 bp, Homo sapiens
tgcagcgttgggatcgtttcggaaggctacaccttc

SEQ ID NO: 1655 - DNA, 33 bp, Homo sapiens
tgcagcgtcgggactacctacgagcagtacttc

SEQ ID NO: 1656 - DNA, 33 bp, Homo sapiens
tgcagcgtgaagacagggaatagctacaccttc

SEQ ID NO: 1657 - DNA, 48 bp, Homo sapiens
tgcagcgttctcggtacagaatcaagctcctacaatgagcagttcttc

SEQ ID NO: 1658 - DNA, 36 bp, Homo sapiens
tgcagcgttccccggttgggcggggagctgtttttt

SEQ ID NO: 1659 - DNA, 33 bp, Homo sapiens
tgcagcgtacaggactactacgagcagtacttc

SEQ ID NO: 1660 - DNA, 39 bp, Homo sapiens
tgcagcgttcaaagcggttacaccggggagctgtttttt

SEQ ID NO: 1661 - DNA, 42 bp, Homo sapiens
tgcagcgtcacggacgtccagttctcctacgagcagtacttc

SEQ ID NO: 1662 - DNA, 42 bp, Homo sapiens
tgcagcgttgttggggacagcttcacagatacgcagtatttt

SEQ ID NO: 1663 - DNA, 36 bp, Homo sapiens
tgcagcgttgttagtggcgcctacgagcagtacttc

SEQ ID NO: 1664 - DNA, 39 bp, Homo sapiens
tgcagcgtttggggggggggaagctacgagcagtacttc

SEQ ID NO: 1665 - DNA, 36 bp, Homo sapiens
tgtgcctgccgggactcggggaatgagcagttcttc

SEQ ID NO: 1666 - DNA, 36 bp, Homo sapiens
tgtgcccgaggctgggggaacgacgagcagtacttc

SEQ ID NO: 1667 - DNA, 33 bp, Homo sapiens
tgtgcctgggacggatacaatgagcagttcttc

SEQ ID NO: 1668 - DNA, 30 bp, Homo sapiens
tgtgcctggggcttagatacgcagtatttt

SEQ ID NO: 1669 - DNA, 30 bp, Homo sapiens
tgtgcctggggcttaaatacgcagtatttt

SEQ ID NO: 1670 - DNA, 39 bp, Homo sapiens
tgtgcctggaaattgacagggctctacgagcagtacttc

SEQ ID NO: 1671 - DNA, 42 bp, Homo sapiens
tgtgcctggaatgtacaagcgggaaaagagacccagtacttc

SEQ ID NO: 1672 - DNA, 42 bp, Homo sapiens
tgtgcctggagagccgggacaggggtgaatgagcagttcttc

SEQ ID NO: 1673 - DNA, 33 bp, Homo sapiens
tgtgcctggagaaatagcggggagcagtacttc

SEQ ID NO: 1674 - DNA, 45 bp, Homo sapiens
tgtgcctggagaactcttagcggggcgtacaatgagcagttcttc

SEQ ID NO: 1675 - DNA, 39 bp, Homo sapiens
tgtgcctggagtgcagacatgaacactgaagctttcttt

SEQ ID NO: 1676 - DNA, 36 bp, Homo sapiens
tgtgcctggagcgacggtgggaagacccagtacttc

SEQ ID NO: 1677 - DNA, 36 bp, Homo sapiens
tgtgcctggagtgaaggtaaccatgagcagttcttc

SEQ ID NO: 1678 - DNA, 42 bp, Homo sapiens
tgtgcctggagtggggacagattccaagatacgcagtatttt

SEQ ID NO: 1679 - DNA, 39 bp, Homo sapiens
tgtgcctggagtggaactagctacaatgagcagttcttc

SEQ ID NO: 1680 - DNA, 30 bp, Homo sapiens
tgtgcctggagtggctacgagcagtacttc

SEQ ID NO: 1681 - DNA, 42 bp, Homo sapiens
tgtgcctggagtaaaaccgggacaggggacgagcagtacttc

SEQ ID NO: 1682 - DNA, 42 bp, Homo sapiens
tgtgcctggagtcctactagcgggaggaatgagcagttcttc

SEQ ID NO: 1683 - DNA, 42 bp, Homo sapiens
tgtgcctggagccgggacagtggcacagatacgcagtatttt

SEQ ID NO: 1684 - DNA, 51 bp, Homo sapiens
tgtgcctggagtagtttcgggggactagcgggttcctacgagcagtacttc

SEQ ID NO: 1685 - DNA, 39 bp, Homo sapiens
tgtgcctggagtacagggggcgcgactgaagctttcttt

SEQ ID NO: 1686 - DNA, 42 bp, Homo sapiens
tgtgcctggagtgtagggacagggggatttgagcagttcttc

SEQ ID NO: 1687 - DNA, 42 bp, Homo sapiens
tgtgcctggagtgtacaagcgggaaaagagacccattacttc

SEQ ID NO: 1688 - DNA, 42 bp, Homo sapiens
tgtgcctggagtgtacaagcgggaaaagagacccagtacttc

SEQ ID NO: 1689 - DNA, 51 bp, Homo sapiens
tgtgcctggagtgtacaagggtattgggaggtccactatggctacaccttc

SEQ ID NO: 1690 - DNA, 41 bp, Homo sapiens
gtgcctggagtgtacaaccgggaaaagaaaccccttacttc

SEQ ID NO: 1691 - DNA, 42 bp, Homo sapiens
tgtgcctggagtgtacaaagcgggtcccatgagcagttcttc

SEQ ID NO: 1692 - DNA, 39 bp, Homo sapiens
tgtgcctggagtgtatcggtgagcctcgagcagtacttc

SEQ ID NO: 1693 - DNA, 48 bp, Homo sapiens
tgtgcctggagtgtaacgggattcccacccaccggggagctgtttttt

SEQ ID NO: 1694 - DNA, 42 bp, Homo sapiens
tgtgcctggagtgtagtggggggggggaatggttaccccttc

SEQ ID NO: 1695 - DNA, 42 bp, Homo sapiens
tgtgcctgggtataccgcgcagctaacactgaagctttcttt

SEQ ID NO: 1696 - DNA, 48 bp, Homo sapiens
tgtccctccggcagggggcgcccgggagggccggagacccagtacttc

SEQ ID NO: 1697 - protein, 14 aa, Homo sapiens
CAGAPRINTGELFF

SEQ ID NO: 1698 - protein, 12 aa, Homo sapiens
CAGFAPNEPQHF

SEQ ID NO: 1699 - protein, 11 aa, Homo sapiens
CAKQRNTEAFF

SEQ ID NO: 1700 - protein, 13 aa, Homo sapiens
CALEEGGYNEQFF

SEQ ID NO: 1701 - protein, 14 aa, Homo sapiens
CANSEAPIDYDQYF

SEQ ID NO: 1702 - protein, 14 aa, Homo sapiens
CANSEAPIDYEQYF

SEQ ID NO: 1703 - protein, 16 aa, Homo sapiens
CANSIDWRKGPDTQYF

SEQ ID NO: 1704 - protein, 13 aa, Homo sapiens
CANVFHEGHGYTF

SEQ ID NO: 1705 - protein, 11 aa, Homo sapiens
CARDITDTQYF

SEQ ID NO: 1706 - protein, 12 aa, Homo sapiens
CASDPGIYGYTF

SEQ ID NO: 1707 - protein, 14 aa, Homo sapiens
CASDSGRSTDTQYF

SEQ ID NO: 1708 - protein, 16 aa, Homo sapiens
CASGGLTSGSRDTQYF

SEQ ID NO: 1709 - protein, 13 aa, Homo sapiens
CASGIQGRNEQFF

SEQ ID NO: 1710 - protein, 17 aa, Homo sapiens
CASKVTEWVQAKNIQYF

SEQ ID NO: 1711 - protein, 13 aa, Homo sapiens
CASLGRGRQPQHF

SEQ ID NO: 1712 - protein, 15 aa, Homo sapiens
CASNDVVYSNHPLDF

SEQ ID NO: 1713 - protein, 14 aa, Homo sapiens
CASNEAPSDYEQYF

SEQ ID NO: 1714 - protein, 14 aa, Homo sapiens
CASNESTSDYEQYF

SEQ ID NO: 1715 - protein, 15 aa, Homo sapiens
CASNRPDSTYYEQYF

SEQ ID NO: 1716 - protein, 15 aa, Homo sapiens
CASRDGTYYTGELFF

SEQ ID NO: 1717 - protein, 13 aa, Homo sapiens
CASRDRGAGELFF

SEQ ID NO: 1718 - protein, 12 aa, Homo sapiens
CASRGGPYEQYF

SEQ ID NO: 1719 - protein, 17 aa, Homo sapiens
CASRVTEWVLAKNIQYF

SEQ ID NO: 1720 - protein, 16 aa, Homo sapiens
CASSARTTGDQETQYF

SEQ ID NO: 1721 - protein, 17 aa, Homo sapiens
CASSDGKDTFMNTEAFF

SEQ ID NO: 1722 - protein, 15 aa, Homo sapiens
CASSDPHRDSTEAFF

SEQ ID NO: 1723 - protein, 15 aa, Homo sapiens
CASSDVGYSNQPQHF

SEQ ID NO: 1724 - protein, 14 aa, Homo sapiens
CASSEAPSDYEQYF

SEQ ID NO: 1725 - protein, 14 aa, Homo sapiens
CASSEAPSNYEQYF

SEQ ID NO: 1726 - protein, 15 aa, Homo sapiens
CASSEAQREGDTQYF

SEQ ID NO: 1727 - protein, 14 aa, Homo sapiens
CASSEATSDYEQYF

SEQ ID NO: 1728 - protein, 14 aa, Homo sapiens
CASSEDGSSGPQHF

SEQ ID NO: 1729 - protein, 15 aa, Homo sapiens
CASSEGGGGAETQYF

SEQ ID NO: 1730 - protein, 15 aa, Homo sapiens
CASSEGGGGQETQYF

SEQ ID NO: 1731 - protein, 15 aa, Homo sapiens
CASSEGLAITDTQYF

SEQ ID NO: 1732 - protein, 16 aa, Homo sapiens
CASSEGSSGFSYEQYF

SEQ ID NO: 1733 - protein, 15 aa, Homo sapiens
CASSEGTSGSYEQYF

SEQ ID NO: 1734 - protein, 16 aa, Homo sapiens
CASSENGAGTSDEQFF

SEQ ID NO: 1735 - protein, 15 aa, Homo sapiens
CASSESGTIMETQYF

SEQ ID NO: 1736 - protein, 15 aa, Homo sapiens
CASSETGSSTDTQYF

SEQ ID NO: 1737 - protein, 13 aa, Homo sapiens
CASSETGTYEQYF

SEQ ID NO: 1738 - protein, 15 aa, Homo sapiens
CASSGEAGGGETQYF

SEQ ID NO: 1739 - protein, 15 aa, Homo sapiens
CASSGGAGGGETQYF

SEQ ID NO: 1740 - protein, 12 aa, Homo sapiens
CASSGGNEPHDF

SEQ ID NO: 1741 - protein, 12 aa, Homo sapiens
CASSGGNEPQHF

SEQ ID NO: 1742 - protein, 12 aa, Homo sapiens
CASSGGNQPHDF

SEQ ID NO: 1743 - protein, 12 aa, Homo sapiens
CASSGGNQSHDF

SEQ ID NO: 1744 - protein, 17 aa, Homo sapiens
CASSGTLLAGARDEQFF

SEQ ID NO: 1745 - protein, 17 aa, Homo sapiens
CASSGTLLSQARDEQFF

SEQ ID NO: 1746 - protein, 17 aa, Homo sapiens
CASSGTSGRPLSYEQYF

SEQ ID NO: 1747 - protein, 15 aa, Homo sapiens
CASSLFWAPPDEQYF

SEQ ID NO: 1748 - protein, 11 aa, Homo sapiens
CASSLTDTHYF

SEQ ID NO: 1749 - protein, 11 aa, Homo sapiens
CASSLTDTQYF

SEQ ID NO: 1750 - protein, 15 aa, Homo sapiens
CASSLVNGRADEQYF

SEQ ID NO: 1751 - protein, 13 aa, Homo sapiens
CASSMTRSTEAFF

SEQ ID NO: 1752 - protein, 14 aa, Homo sapiens
CASSNGGGNTEAFF

SEQ ID NO: 1753 - protein, 15 aa, Homo sapiens
CASSPESLRTDTQYF

SEQ ID NO: 1754 - protein, 14 aa, Homo sapiens
CASSQGLEADEQYF

SEQ ID NO: 1755 - protein, 15 aa, Homo sapiens
CASSSGTSPYNEQFF

SEQ ID NO: 1756 - protein, 13 aa, Homo sapiens
CASSSPGSYEQYF

SEQ ID NO: 1757 - protein, 13 aa, Homo sapiens
CASSSSGADTQYF

SEQ ID NO: 1758 - protein, 15 aa, Homo sapiens
CASSTLAGSTDTQYF

SEQ ID NO: 1759 - protein, 12 aa, Homo sapiens
CASSVQGLEAFF

SEQ ID NO: 1760 - protein, 14 aa, Homo sapiens
CASTEAPNDYEQYF

SEQ ID NO: 1761 - protein, 14 aa, Homo sapiens
CASTFEGDTDTQYF

SEQ ID NO: 1762 - protein, 14 aa, Homo sapiens
CASGHLRSYNEQFF

SEQ ID NO: 1763 - protein, 16 aa, Homo sapiens
CASHYRASVNTGELFF

SEQ ID NO: 1764 - protein, 12 aa, Homo sapiens
CASSEGLYGYTF

SEQ ID NO: 1765 - protein, 16 aa, Homo sapiens
CASSHLAASSYNEQFF

SEQ ID NO: 1766 - protein, 17 aa, Homo sapiens
CASSHSMGGGGYNEQFF

SEQ ID NO: 1767 - protein, 16 aa, Homo sapiens
CASSHTSGRAGNEQFF

SEQ ID NO: 1768 - protein, 16 aa, Homo sapiens
CASSLRSGGGGDTQYF

SEQ ID NO: 1769 - protein, 16 aa, Homo sapiens
CASSLSGNRSIQTPSF

SEQ ID NO: 1770 - protein, 15 aa, Homo sapiens
CASSLSSGRTYEQYF

SEQ ID NO: 1771 - protein, 13 aa, Homo sapiens
CASSPAGTREQFF

SEQ ID NO: 1772 - protein, 15 aa, Homo sapiens
CASSPLAGFTDTQYF

SEQ ID NO: 1773 - protein, 16 aa, Homo sapiens
CASSPPTGDFYSPLHF

SEQ ID NO: 1774 - protein, 15 aa, Homo sapiens
CASSPRAGAGGEQFF

SEQ ID NO: 1775 - protein, 14 aa, Homo sapiens
CASSPRPGGEKLFF

SEQ ID NO: 1776 - protein, 15 aa, Homo sapiens
CASSPSGTLEATQYF

SEQ ID NO: 1777 - protein, 15 aa, Homo sapiens
CASSPSRGAYNEQFF

SEQ ID NO: 1778 - protein, 15 aa, Homo sapiens
CASSPWTGSSYEQYF

SEQ ID NO: 1779 - protein, 16 aa, Homo sapiens
CASSQAQGSLSYEQYF

SEQ ID NO: 1780 - protein, 14 aa, Homo sapiens
CASSQDATGNGYTF

SEQ ID NO: 1781 - protein, 17 aa, Homo sapiens
CASSQDRTGVGNQPQHF

SEQ ID NO: 1782 - protein, 14 aa, Homo sapiens
CASSQDSGPYEQYF

SEQ ID NO: 1783 - protein, 14 aa, Homo sapiens
CASSQDSPSYGYTF

SEQ ID NO: 1784 - protein, 17 aa, Homo sapiens
CASSQEGPYSSYNEQFF

SEQ ID NO: 1785 - protein, 12 aa, Homo sapiens
CASSQGMDGYAF

SEQ ID NO: 1786 - protein, 15 aa, Homo sapiens
CASSQPGQRRGGYTF

SEQ ID NO: 1787 - protein, 16 aa, Homo sapiens
CASSQPTSGSIYEQFF

SEQ ID NO: 1788 - protein, 15 aa, Homo sapiens
CASSQQLREGDEQYF

SEQ ID NO: 1789 - protein, 16 aa, Homo sapiens
CASSQRVGLATNEQFF

SEQ ID NO: 1790 - protein, 15 aa, Homo sapiens
CASSQSGGKTYEQYF

SEQ ID NO: 1791 - protein, 18 aa, Homo sapiens
CASSQVIGDLSGANVLTF

SEQ ID NO: 1792 - protein, 19 aa, Homo sapiens
CASSRGLTREGLSYNEQFF

SEQ ID NO: 1793 - protein, 17 aa, Homo sapiens
CASSRPAGALGANVLTF

SEQ ID NO: 1794 - protein, 14 aa, Homo sapiens
CASSRRQQNEKLFF

SEQ ID NO: 1795 - protein, 18 aa, Homo sapiens
CASSSQWTEEPKGYGYTF

SEQ ID NO: 1796 - protein, 14 aa, Homo sapiens
CASTPSTENTEAFF

SEQ ID NO: 1797 - protein, 15 aa, Homo sapiens
CAGSQGLGRGNTIYF

SEQ ID NO: 1798 - protein, 12 aa, Homo sapiens
CASRQGPNEQFF

SEQ ID NO: 1799 - protein, 15 aa, Homo sapiens
CASRTGQGSTGELFF

SEQ ID NO: 1800 - protein, 10 aa, Homo sapiens
CASSDGSQYF

SEQ ID NO: 1801 - protein, 13 aa, Homo sapiens
CASSHPQAGELFF

SEQ ID NO: 1802 - protein, 17 aa, Homo sapiens
CASSHPRLAGDDNEQFF

SEQ ID NO: 1803 - protein, 16 aa, Homo sapiens
CASSHPRTDHQETQYF

SEQ ID NO: 1804 - protein, 16 aa, Homo sapiens
CASSHPSAGSAGEQYF

SEQ ID NO: 1805 - protein, 15 aa, Homo sapiens
CASSHRRQVNSPLHF

SEQ ID NO: 1806 - protein, 17 aa, Homo sapiens
CASSKGEGRISGNTIYF

SEQ ID NO: 1807 - protein, 15 aa, Homo sapiens
CASSLDRTNTGELFF

SEQ ID NO: 1808 - protein, 12 aa, Homo sapiens
CASSLGDEEQFF

SEQ ID NO: 1809 - protein, 14 aa, Homo sapiens
CASSLGLTNNEQFF

SEQ ID NO: 1810 - protein, 16 aa, Homo sapiens
CASSLRLAGDAETQYF

SEQ ID NO: 1811 - protein, 16 aa, Homo sapiens
CASSLTVAGGMNEQYF

SEQ ID NO: 1812 - protein, 15 aa, Homo sapiens
CASSLVAKSYNEQFF

SEQ ID NO: 1813 - protein, 16 aa, Homo sapiens
CASSLVQYSPNTEAFF

SEQ ID NO: 1814 - protein, 16 aa, Homo sapiens
CASSNGQGRNNSPLHF

SEQ ID NO: 1815 - protein, 16 aa, Homo sapiens
CASSPAGTLNTGELFF

SEQ ID NO: 1816 - protein, 14 aa, Homo sapiens
CASSPGGSNYGYTF

SEQ ID NO: 1817 - protein, 15 aa, Homo sapiens
CASSPGQHSNQPQHF

SEQ ID NO: 1818 - protein, 16 aa, Homo sapiens
CASSPLDSGAGTDQYF

SEQ ID NO: 1819 - protein, 16 aa, Homo sapiens
CASSPLDSGAGTEQYF

SEQ ID NO: 1820 - protein, 15 aa, Homo sapiens
CASSPLRVGPYEQYF

SEQ ID NO: 1821 - protein, 12 aa, Homo sapiens
CASSPPEGTQYF

SEQ ID NO: 1822 - protein, 15 aa, Homo sapiens
CASSPRSSNTGELFF

SEQ ID NO: 1823 - protein, 15 aa, Homo sapiens
CASSPRTETNYGYTF

SEQ ID NO: 1824 - protein, 15 aa, Homo sapiens
CASSPRTSGEETQYF

SEQ ID NO: 1825 - protein, 15 aa, Homo sapiens
CASSPSGGALETQYF

SEQ ID NO: 1826 - protein, 14 aa, Homo sapiens
CASSPSGQGRSAFF

SEQ ID NO: 1827 - protein, 17 aa, Homo sapiens
CASSPSHTGNTGNTIYF

SEQ ID NO: 1828 - protein, 13 aa, Homo sapiens
CASSPSLYNEQFF

SEQ ID NO: 1829 - protein, 15 aa, Homo sapiens
CASSPSRGPSYEQYF

SEQ ID NO: 1830 - protein, 13 aa, Homo sapiens
CASSPYTGNTIYF

SEQ ID NO: 1831 - protein, 16 aa, Homo sapiens
CASSQAFQGSNTEAFF

SEQ ID NO: 1832 - protein, 14 aa, Homo sapiens
CASSQAGAAYEQYF

SEQ ID NO: 1833 - protein, 17 aa, Homo sapiens
CASSQASGLAGGYEQYF

SEQ ID NO: 1834 - protein, 15 aa, Homo sapiens
CASSQDERVTETQYF

SEQ ID NO: 1835 - protein, 14 aa, Homo sapiens
CASSQDFGRTEQYF

SEQ ID NO: 1836 - protein, 17 aa, Homo sapiens
CASSQDGEGGADYGYTF

SEQ ID NO: 1837 - protein, 16 aa, Homo sapiens
CASSQDIGTGPTEAFF

SEQ ID NO: 1838 - protein, 16 aa, Homo sapiens
CASSQDLGGSGNTIYF

SEQ ID NO: 1839 - protein, 15 aa, Homo sapiens
CASSQDLGPSTEAFF

SEQ ID NO: 1840 - protein, 16 aa, Homo sapiens
CASSQDPGMETGELFF

SEQ ID NO: 1841 - protein, 13 aa, Homo sapiens
CASSQDPGYEQYF

SEQ ID NO: 1842 - protein, 13 aa, Homo sapiens
CASSQDSDQTHHF

SEQ ID NO: 1843 - protein, 16 aa, Homo sapiens
CASSQDSGSSYNEQFF

SEQ ID NO: 1844 - protein, 15 aa, Homo sapiens
CASSQDSGIGQPQHF

SEQ ID NO: 1845 - protein, 15 aa, Homo sapiens
CASSQDSGPSYEQYF

SEQ ID NO: 1846 - protein, 14 aa, Homo sapiens
CASSQDSHTGELFF

SEQ ID NO: 1847 - protein, 13 aa, Homo sapiens
CASSQDSNQPQHF

SEQ ID NO: 1848 - protein, 18 aa, Homo sapiens
CASSQDSPLASSSYEQYF

SEQ ID NO: 1849 - protein, 14 aa, Homo sapiens
CASSQDTYQETQYF

SEQ ID NO: 1850 - protein, 15 aa, Homo sapiens
CASSQEDRVSETQYF

SEQ ID NO: 1851 - protein, 17 aa, Homo sapiens
CASSQEEGGMINQPQHF

SEQ ID NO: 1852 - protein, 14 aa, Homo sapiens
CASSQEFGGDEQFF

SEQ ID NO: 1853 - protein, 17 aa, Homo sapiens
CASSQEGAGLSTDTQYF

SEQ ID NO: 1854 - protein, 14 aa, Homo sapiens
CASSQEGASHGYTF

SEQ ID NO: 1855 - protein, 18 aa, Homo sapiens
CASSQEGQLAEGGGELFF

SEQ ID NO: 1856 - protein, 14 aa, Homo sapiens
CASSQEGRGNEQFF

SEQ ID NO: 1857 - protein, 15 aa, Homo sapiens
CASSQEHRGLYEQYF

SEQ ID NO: 1858 - protein, 17 aa, Homo sapiens
CASSQELGGGTKYEQYF

SEQ ID NO: 1859 - protein, 15 aa, Homo sapiens
CASSQEPGGVEKLFF

SEQ ID NO: 1860 - protein, 16 aa, Homo sapiens
CASSQEQAGGVVTQYF

SEQ ID NO: 1861 - protein, 16 aa, Homo sapiens
CASSQERGEGRDTQYF

SEQ ID NO: 1862 - protein, 17 aa, Homo sapiens
CASSQERGRISGNTIYF

SEQ ID NO: 1863 - protein, 15 aa, Homo sapiens
CASSQEVAGVREQYF

SEQ ID NO: 1864 - protein, 16 aa, Homo sapiens
CASSQEWPESGHTIYF

SEQ ID NO: 1865 - protein, 14 aa, Homo sapiens
CASSQGAGGYEQYF

SEQ ID NO: 1866 - protein, 15 aa, Homo sapiens
CASSQGDRNYSPLHF

SEQ ID NO: 1867 - protein, 15 aa, Homo sapiens
CASSQGDRYVTEAFF

SEQ ID NO: 1868 - protein, 14 aa, Homo sapiens
CASSQGDSSYEQYF

SEQ ID NO: 1869 - protein, 14 aa, Homo sapiens
CASSQGGEGYEQYF

SEQ ID NO: 1870 - protein, 15 aa, Homo sapiens
CASSQGGGETYEQYF

SEQ ID NO: 1871 - protein, 17 aa, Homo sapiens
CASSQGGGQGFITEAFF

SEQ ID NO: 1872 - protein, 13 aa, Homo sapiens
CASSQGGPGELFF

SEQ ID NO: 1873 - protein, 14 aa, Homo sapiens
CASSQGGTQETQYF

SEQ ID NO: 1874 - protein, 16 aa, Homo sapiens
CASSQGLAGGPGTQYF

SEQ ID NO: 1875 - protein, 19 aa, Homo sapiens
CASSQGMRASWGFDNEQFF

SEQ ID NO: 1876 - protein, 15 aa, Homo sapiens
CASSQGRYSNQPQHF

SEQ ID NO: 1877 - protein, 16 aa, Homo sapiens
CASSQGVGRANYGYTF

SEQ ID NO: 1878 - protein, 16 aa, Homo sapiens
CASSQKLAGDTDTQYF

SEQ ID NO: 1879 - protein, 17 aa, Homo sapiens
CASSQKPGLAGFNEQYF

SEQ ID NO: 1880 - protein, 14 aa, Homo sapiens
CASSQKWGNHPQHF

SEQ ID NO: 1881 - protein, 19 aa, Homo sapiens
CASSQKYRVLELGTDTQYF

SEQ ID NO: 1882 - protein, 16 aa, Homo sapiens
CASSQLAGGVADTQYF

SEQ ID NO: 1883 - protein, 17 aa, Homo sapiens
CASSQLGTGGAGETQYF

SEQ ID NO: 1884 - protein, 16 aa, Homo sapiens
CASSQPGLAGYDEQFF

SEQ ID NO: 1885 - protein, 15 aa, Homo sapiens
CASSQPLGQKETQYF

SEQ ID NO: 1886 - protein, 15 aa, Homo sapiens
CASSQRAVGDYGYTF

SEQ ID NO: 1887 - protein, 16 aa, Homo sapiens
CASSQRGTSGKNEQFF

SEQ ID NO: 1888 - protein, 14 aa, Homo sapiens
CASSQRQTGYEQYF

SEQ ID NO: 1889 - protein, 18 aa, Homo sapiens
CASSQSLAVATSYNEQFF

SEQ ID NO: 1890 - protein, 16 aa, Homo sapiens
CASSQTGRGPSYEQYF

SEQ ID NO: 1891 - protein, 14 aa, Homo sapiens
CASSQTGTSYEQYF

SEQ ID NO: 1892 - protein, 16 aa, Homo sapiens
CASSQVRSGGAYEQYF

SEQ ID NO: 1893 - protein, 15 aa, Homo sapiens
CASSQVSEANYGYTF

SEQ ID NO: 1894 - protein, 15 aa, Homo sapiens
CASSQVTGGSYGYTF

SEQ ID NO: 1895 - protein, 16 aa, Homo sapiens
CASSQVTGTGRYEQYF

SEQ ID NO: 1896 - protein, 13 aa, Homo sapiens
CASSQVTSYEQYF

SEQ ID NO: 1897 - protein, 16 aa, Homo sapiens
CASSRGLAGGHNEQFF

SEQ ID NO: 1898 - protein, 18 aa, Homo sapiens
CASSSDTSGSTRGNEQFF

SEQ ID NO: 1899 - protein, 13 aa, Homo sapiens
CASSSRGWKTQYF

SEQ ID NO: 1900 - protein, 14 aa, Homo sapiens
CASSTSSRDNEQFF

SEQ ID NO: 1901 - protein, 15 aa, Homo sapiens
CASSYDRETNEKLFF

SEQ ID NO: 1902 - protein, 14 aa, Homo sapiens
CASSYYQGGGEQYF

SEQ ID NO: 1903 - protein, 15 aa, Homo sapiens
CACSFGERGYNGQFF

SEQ ID NO: 1904 - protein, 19 aa, Homo sapiens
CANPPIVGAVVSGANVLTF

SEQ ID NO: 1905 - protein, 15 aa, Homo sapiens
CANSFGDRANNEQFF

SEQ ID NO: 1906 - protein, 15 aa, Homo sapiens
CAPSFGDRAYSDKFF

SEQ ID NO: 1907 - protein, 14 aa, Homo sapiens
CAREGQGPYNEQFF

SEQ ID NO: 1908 - protein, 13 aa, Homo sapiens
CARSFASGYEQFF

SEQ ID NO: 1909 - protein, 12 aa, Homo sapiens
CASEGGPDEQFF

SEQ ID NO: 1910 - protein, 15 aa, Homo sapiens
CASGTLATSTDTQYF

SEQ ID NO: 1911 - protein, 14 aa, Homo sapiens
CASHQAGGYTEAFF

SEQ ID NO: 1912 - protein, 15 aa, Homo sapiens
CASKLAGGTQETQYF

SEQ ID NO: 1913 - protein, 12 aa, Homo sapiens
CASMVGDTEAFF

SEQ ID NO: 1914 - protein, 15 aa, Homo sapiens
CASNLGLNPYNEQFF

SEQ ID NO: 1915 - protein, 15 aa, Homo sapiens
CASPFGDRPYHEQFF

SEQ ID NO: 1916 - protein, 14 aa, Homo sapiens
CASRDEGLWNEQFF

SEQ ID NO: 1917 - protein, 13 aa, Homo sapiens
CASRGESYNEQFF

SEQ ID NO: 1918 - protein, 12 aa, Homo sapiens
CASRIQGYEQYF

SEQ ID NO: 1919 - protein, 15 aa, Homo sapiens
CASRLGESSYNEQFF

SEQ ID NO: 1920 - protein, 15 aa, Homo sapiens
CASRLRDFTYNEQFF

SEQ ID NO: 1921 - protein, 15 aa, Homo sapiens
CASRPLAEIYNEQFF

SEQ ID NO: 1922 - protein, 14 aa, Homo sapiens
CASRPPRQTDTQYF

SEQ ID NO: 1923 - protein, 13 aa, Homo sapiens
CASRQGTTNEQFF

SEQ ID NO: 1924 - protein, 14 aa, Homo sapiens
CASRRRDDTDTQYF

SEQ ID NO: 1925 - protein, 17 aa, Homo sapiens
CASSAGGFSGRGLEQYF

SEQ ID NO: 1926 - protein, 16 aa, Homo sapiens
CASSASAGVEADTQYF

SEQ ID NO: 1927 - protein, 14 aa, Homo sapiens
CASSASGGYNEQFF

SEQ ID NO: 1928 - protein, 18 aa, Homo sapiens
CASSENSPLAGGRNEQFF

SEQ ID NO: 1929 - protein, 15 aa, Homo sapiens
CASSFAGSSSYEQYF

SEQ ID NO: 1930 - protein, 14 aa, Homo sapiens
CASSFDKNSYEQYF

SEQ ID NO: 1931 - protein, 16 aa, Homo sapiens
CASSFEAGGSYNEQFF

SEQ ID NO: 1932 - protein, 11 aa, Homo sapiens
CASSFFNEQFF

SEQ ID NO: 1933 - protein, 15 aa, Homo sapiens
CASSFGASGGYEQYF

SEQ ID NO: 1934 - protein, 15 aa, Homo sapiens
CASSFGDIGSYEQYF

SEQ ID NO: 1935 - protein, 15 aa, Homo sapiens
CASSFGDRANNEQFF

SEQ ID NO: 1936 - protein, 15 aa, Homo sapiens
CASSFGDRAYNEQFF

SEQ ID NO: 1937 - protein, 15 aa, Homo sapiens
CASSFGDRAYYEQFF

SEQ ID NO: 1938 - protein, 15 aa, Homo sapiens
CASSFGDRDYNEQFF

SEQ ID NO: 1939 - protein, 15 aa, Homo sapiens
CASSFGGRAYNEQSF

SEQ ID NO: 1940 - protein, 16 aa, Homo sapiens
CASSFGTATEGYGYTF

SEQ ID NO: 1941 - protein, 12 aa, Homo sapiens
CASSFGTEKAFF

SEQ ID NO: 1942 - protein, 15 aa, Homo sapiens
CASSFGTGALGEQYF

SEQ ID NO: 1943 - protein, 15 aa, Homo sapiens
CASSFLAGLYNEQFF

SEQ ID NO: 1944 - protein, 15 aa, Homo sapiens
CASSFLGLRYNEQFF

SEQ ID NO: 1945 - protein, 14 aa, Homo sapiens
CASSFLGSGETQYF

SEQ ID NO: 1946 - protein, 13 aa, Homo sapiens
CASSFNSGNTIYF

SEQ ID NO: 1947 - protein, 13 aa, Homo sapiens
CASSFPGLNEQYF

SEQ ID NO: 1948 - protein, 15 aa, Homo sapiens
CASSFPGTGGHEQYF

SEQ ID NO: 1949 - protein, 16 aa, Homo sapiens
CASSFPNHLSSYEQYF

SEQ ID NO: 1950 - protein, 15 aa, Homo sapiens
CASSFPTGGRDEQFF

SEQ ID NO: 1951 - protein, 15 aa, Homo sapiens
CASSFRDGTQETQYF

SEQ ID NO: 1952 - protein, 15 aa, Homo sapiens
CASSFRDRPKETQYF

SEQ ID NO: 1953 - protein, 15 aa, Homo sapiens
CASSFRDRSSYEQYF

SEQ ID NO: 1954 - protein, 14 aa, Homo sapiens
CASSFRDTYNEQFF

SEQ ID NO: 1955 - protein, 15 aa, Homo sapiens
CASSFRGSGNQPQHF

SEQ ID NO: 1956 - protein, 14 aa, Homo sapiens
CASSFRLSYNEQFF

SEQ ID NO: 1957 - protein, 14 aa, Homo sapiens
CASSFSGAYNEQFF

SEQ ID NO: 1958 - protein, 14 aa, Homo sapiens
CASSFSGAYNERFF

SEQ ID NO: 1959 - protein, 17 aa, Homo sapiens
CASSFSGTSDFYNEQFF

SEQ ID NO: 1960 - protein, 12 aa, Homo sapiens
CASSFSNTEAFF

SEQ ID NO: 1961 - protein, 20 aa, Homo sapiens
CASSFSPGGQPLSGANVLTF

SEQ ID NO: 1962 - protein, 15 aa, Homo sapiens
CASSFTGGDAEKLFF

SEQ ID NO: 1963 - protein, 15 aa, Homo sapiens
CASSFVGKPYNEQFF

SEQ ID NO: 1964 - protein, 15 aa, Homo sapiens
CASSGGQGTVYEQYF

SEQ ID NO: 1965 - protein, 12 aa, Homo sapiens
CASSGGRTESFF

SEQ ID NO: 1966 - protein, 12 aa, Homo sapiens
CASSGGSYEQYF

SEQ ID NO: 1967 - protein, 14 aa, Homo sapiens
CASSGTSGRDTQYF

SEQ ID NO: 1968 - protein, 16 aa, Homo sapiens
CASSHGSDGPQETQYF

SEQ ID NO: 1969 - protein, 14 aa, Homo sapiens
CASSHGTGSGGYTF

SEQ ID NO: 1970 - protein, 15 aa, Homo sapiens
CASSIGGSGIETQYF

SEQ ID NO: 1971 - protein, 14 aa, Homo sapiens
CASSLAGGEETQYF

SEQ ID NO: 1972 - protein, 14 aa, Homo sapiens
CASSLAGGYNEQFF

SEQ ID NO: 1973 - protein, 14 aa, Homo sapiens
CASSLAGGYTEAFF

SEQ ID NO: 1974 - protein, 14 aa, Homo sapiens
CASSLAGGYVEQFF

SEQ ID NO: 1975 - protein, 16 aa, Homo sapiens
CASSLAGLINTGELFF

SEQ ID NO: 1976 - protein, 14 aa, Homo sapiens
CASSLAGSDYGYTF

SEQ ID NO: 1977 - protein, 15 aa, Homo sapiens
CASSLAMRYQETQYF

SEQ ID NO: 1978 - protein, 13 aa, Homo sapiens
CASSLAPAYEQYF

SEQ ID NO: 1979 - protein, 15 aa, Homo sapiens
CASSLAPGVGNEQFF

SEQ ID NO: 1980 - protein, 22 aa, Homo sapiens
CASSLARGWTSGLFPSLNEQFF

SEQ ID NO: 1981 - protein, 14 aa, Homo sapiens
CASSLASGEETQYF

SEQ ID NO: 1982 - protein, 13 aa, Homo sapiens
CASSLATDYEQYF

SEQ ID NO: 1983 - protein, 14 aa, Homo sapiens
CASSLATGSYEQYF

SEQ ID NO: 1984 - protein, 15 aa, Homo sapiens
CASSLAVGSADTQYF

SEQ ID NO: 1985 - protein, 20 aa, Homo sapiens
CASSLAYRDRVALTYNEQFF

SEQ ID NO: 1986 - protein, 14 aa, Homo sapiens
CASSLAYVNYGYSF

SEQ ID NO: 1987 - protein, 14 aa, Homo sapiens
CASSLAYVNYGYTF

SEQ ID NO: 1988 - protein, 12 aa, Homo sapiens
CASSLDDSIQYF

SEQ ID NO: 1989 - protein, 16 aa, Homo sapiens
CASSLDFGITADTQYF

SEQ ID NO: 1990 - protein, 14 aa, Homo sapiens
CASSLDGGPYEQYF

SEQ ID NO: 1991 - protein, 14 aa, Homo sapiens
CASSLDGNNQPQHF

SEQ ID NO: 1992 - protein, 15 aa, Homo sapiens
CASSLDNSGANVLTF

SEQ ID NO: 1993 - protein, 14 aa, Homo sapiens
CASSLDRAWETQYF

SEQ ID NO: 1994 - protein, 13 aa, Homo sapiens
CASSLDRGETQYF

SEQ ID NO: 1995 - protein, 13 aa, Homo sapiens
CASSLDSCNEQFF

SEQ ID NO: 1996 - protein, 13 aa, Homo sapiens
CASSLDSYNEQFF

SEQ ID NO: 1997 - protein, 18 aa, Homo sapiens
CASSLEAGGTGYQETQYF

SEQ ID NO: 1998 - protein, 15 aa, Homo sapiens
CASSLEGAGLNTQYF

SEQ ID NO: 1999 - protein, 15 aa, Homo sapiens
CASSLEGPGDTEAFF

SEQ ID NO: 2000 - protein, 13 aa, Homo sapiens
CASSLEGQETQYF

SEQ ID NO: 2001 - protein, 17 aa, Homo sapiens
CASSLEGSGRAYREQFF

SEQ ID NO: 2002 - protein, 15 aa, Homo sapiens
CASSLESALTDTQYF

SEQ ID NO: 2003 - protein, 13 aa, Homo sapiens
CASSLESRDEQYF

SEQ ID NO: 2004 - protein, 14 aa, Homo sapiens
CASSLFSGSYEQYF

SEQ ID NO: 2005 - protein, 17 aa, Homo sapiens
CASSLFVREGSYNEQFF

SEQ ID NO: 2006 - protein, 17 aa, Homo sapiens
CASSLGAGGPFGYEQYF

SEQ ID NO: 2007 - protein, 18 aa, Homo sapiens
CASSLGAGIQKGYNEQFF

SEQ ID NO: 2008 - protein, 16 aa, Homo sapiens
CASSLGDGSSTDTQYF

SEQ ID NO: 2009 - protein, 16 aa, Homo sapiens
CASSLGDRGLGETQYF

SEQ ID NO: 2010 - protein, 15 aa, Homo sapiens
CASSLGDRDNYDEFF

SEQ ID NO: 2011 - protein, 17 aa, Homo sapiens
CASSLGGPSGSSGELFF

SEQ ID NO: 2012 - protein, 16 aa, Homo sapiens
CASSLGGQGLNTEAFF

SEQ ID NO: 2013 - protein, 16 aa, Homo sapiens
CASSLGIGGSYNEQFF

SEQ ID NO: 2014 - protein, 15 aa, Homo sapiens
CASSLGPDWHTGELF

SEQ ID NO: 2015 - protein, 16 aa, Homo sapiens
CASSLGPDRGVNEQFF

SEQ ID NO: 2016 - protein, 14 aa, Homo sapiens
CASSLGPTLHGYTF

SEQ ID NO: 2017 - protein, 15 aa, Homo sapiens
CASSLGQGSGNTIYF

SEQ ID NO: 2018 - protein, 14 aa, Homo sapiens
CASSLGRGYEKLFF

SEQ ID NO: 2019 - protein, 17 aa, Homo sapiens
CASSLGRLSHGADTQYF

SEQ ID NO: 2020 - protein, 16 aa, Homo sapiens
CASSLGSAFSGNTIYF

SEQ ID NO: 2021 - protein, 16 aa, Homo sapiens
CASSLGSGGFGTEAFF

SEQ ID NO: 2022 - protein, 20 aa, Homo sapiens
CASSLGSGGNPSSGANVLTF

SEQ ID NO: 2023 - protein, 16 aa, Homo sapiens
CASSLGSGGPYTEAFF

SEQ ID NO: 2024 - protein, 18 aa, Homo sapiens
CASSLGSRPRLNTGELFF

SEQ ID NO: 2025 - protein, 16 aa, Homo sapiens
CASSLGTGGLYTEAFF

SEQ ID NO: 2026 - protein, 14 aa, Homo sapiens
CASSLGTGGYGYTF

SEQ ID NO: 2027 - protein, 15 aa, Homo sapiens
CASSLGTGRADTQYF

SEQ ID NO: 2028 - protein, 15 aa, Homo sapiens
CASSLGTGRDDEQFF

SEQ ID NO: 2029 - protein, 15 aa, Homo sapiens
CASSLGTTELAGEFF

SEQ ID NO: 2030 - protein, 14 aa, Homo sapiens
CASSLGTWNYEQYF

SEQ ID NO: 2031 - protein, 16 aa, Homo sapiens
CASSLGVAGGLNEQYF

SEQ ID NO: 2032 - protein, 15 aa, Homo sapiens
CASSLGVSGLKTQYF

SEQ ID NO: 2033 - protein, 14 aa, Homo sapiens
CASSLGVSGSEQYF

SEQ ID NO: 2034 - protein, 14 aa, Homo sapiens
CASSLGVSYTEAFF

SEQ ID NO: 2035 - protein, 16 aa, Homo sapiens
CASSLGWRETYDEHFF

SEQ ID NO: 2036 - protein, 16 aa, Homo sapiens
CASSLGWRETYDEQFF

SEQ ID NO: 2037 - protein, 16 aa, Homo sapiens
CASSLGWRETYNEQFF

SEQ ID NO: 2038 - protein, 18 aa, Homo sapiens
CASSLIPVGVTSYHEQFF

SEQ ID NO: 2039 - protein, 15 aa, Homo sapiens
CASSLLAGGNYGYTF

SEQ ID NO: 2040 - protein, 15 aa, Homo sapiens
CASSLLGGLGTEAFF

SEQ ID NO: 2041 - protein, 16 aa, Homo sapiens
CASSLLGSAKYNEQFF

SEQ ID NO: 2042 - protein, 15 aa, Homo sapiens
CASSLLKEKADTQYF

SEQ ID NO: 2043 - protein, 15 aa, Homo sapiens
CASSLLREHQDTQYF

SEQ ID NO: 2044 - protein, 15 aa, Homo sapiens
CASSLLREHRDTQYF

SEQ ID NO: 2045 - protein, 15 aa, Homo sapiens
CASSLLREKADTQYF

SEQ ID NO: 2046 - protein, 15 aa, Homo sapiens
CASSLLRESTDTQYF

SEQ ID NO: 2047 - protein, 15 aa, Homo sapiens
CASSLLSGGGETQYF

SEQ ID NO: 2048 - protein, 14 aa, Homo sapiens
CASSLMEGSYGYTF

SEQ ID NO: 2049 - protein, 15 aa, Homo sapiens
CASSLNALAVNEQFF

SEQ ID NO: 2050 - protein, 13 aa, Homo sapiens
CASSLNEEETQYF

SEQ ID NO: 2051 - protein, 18 aa, Homo sapiens
CASSLRAGWEEDTDTQYF

SEQ ID NO: 2052 - protein, 15 aa, Homo sapiens
CASSLRAGGLDEQYF

SEQ ID NO: 2053 - protein, 16 aa, Homo sapiens
CASSLRLYSHNTEAFF

SEQ ID NO: 2054 - protein, 13 aa, Homo sapiens
CASSLRQSPEQYF

SEQ ID NO: 2055 - protein, 11 aa, Homo sapiens
CASSLRREQFF

SEQ ID NO: 2056 - protein, 14 aa, Homo sapiens
CASSLSGGYNEQFF

SEQ ID NO: 2057 - protein, 16 aa, Homo sapiens
CASSLSGLAGVREQFF

SEQ ID NO: 2058 - protein, 16 aa, Homo sapiens
CASSLSGRKVSYEQYF

SEQ ID NO: 2059 - protein, 12 aa, Homo sapiens
CASSLSRGRAFF

SEQ ID NO: 2060 - protein, 16 aa, Homo sapiens
CASSLSSDISQETQYF

SEQ ID NO: 2061 - protein, 12 aa, Homo sapiens
CASSLTAYEQYF

SEQ ID NO: 2062 - protein, 15 aa, Homo sapiens
CASSLTGGSYNEQFF

SEQ ID NO: 2063 - protein, 13 aa, Homo sapiens
CASSLVGEREQFF

SEQ ID NO: 2064 - protein, 15 aa, Homo sapiens
CASSLVGGRFETQYF

SEQ ID NO: 2065 - protein, 13 aa, Homo sapiens
CASSLVGIETQYF

SEQ ID NO: 2066 - protein, 11 aa, Homo sapiens
CASSLVLEQFF

SEQ ID NO: 2067 - protein, 15 aa, Homo sapiens
CASSLWDGGEETQYF

SEQ ID NO: 2068 - protein, 16 aa, Homo sapiens
CASSLWTRIYQETQYF

SEQ ID NO: 2069 - protein, 16 aa, Homo sapiens
CASSLYLGVRGHEQFF

SEQ ID NO: 2070 - protein, 16 aa, Homo sapiens
CASSLYPLSSYNEQFF

SEQ ID NO: 2071 - protein, 15 aa, Homo sapiens
CASSMFLVGAETQYF

SEQ ID NO: 2072 - protein, 12 aa, Homo sapiens
CASSNDFTEAFF

SEQ ID NO: 2073 - protein, 12 aa, Homo sapiens
CASSPADYEQYF

SEQ ID NO: 2074 - protein, 15 aa, Homo sapiens
CASSPAGLADYEQYF

SEQ ID NO: 2075 - protein, 14 aa, Homo sapiens
CASSPDARDDEQFF

SEQ ID NO: 2076 - protein, 13 aa, Homo sapiens
CASSPFYNTEAFF

SEQ ID NO: 2077 - protein, 15 aa, Homo sapiens
CASSPGQGLVNEQFF

SEQ ID NO: 2078 - protein, 15 aa, Homo sapiens
CASSPGRENTGELFF

SEQ ID NO: 2079 - protein, 14 aa, Homo sapiens
CASSPGTGVAEQYF

SEQ ID NO: 2080 - protein, 14 aa, Homo sapiens
CASSPGWGAYEQYF

SEQ ID NO: 2081 - protein, 16 aa, Homo sapiens
CASSPLVGGTYNEQFF

SEQ ID NO: 2082 - protein, 15 aa, Homo sapiens
CASSPPTGRAGELFF

SEQ ID NO: 2083 - protein, 14 aa, Homo sapiens
CASSPSGGYNEQFF

SEQ ID NO: 2084 - protein, 15 aa, Homo sapiens
CASSPVSPTRETQYF

SEQ ID NO: 2085 - protein, 16 aa, Homo sapiens
CASSPWGGGRAGELFF

SEQ ID NO: 2086 - protein, 14 aa, Homo sapiens
CASSPWTSGRAGFF

SEQ ID NO: 2087 - protein, 15 aa, Homo sapiens
CASSQGHRSYNEQFF

SEQ ID NO: 2088 - protein, 16 aa, Homo sapiens
CASSQGLAGPYNEQFF

SEQ ID NO: 2089 - protein, 14 aa, Homo sapiens
CASSRIGGSDTQYF

SEQ ID NO: 2090 - protein, 19 aa, Homo sapiens
CASSRIPLTSGRADWEQYF

SEQ ID NO: 2091 - protein, 15 aa, Homo sapiens
CASSRMGQGRTEAFF

SEQ ID NO: 2092 - protein, 15 aa, Homo sapiens
CASSRRGADRNEQFF

SEQ ID NO: 2093 - protein, 14 aa, Homo sapiens
CASSSAGGYNEQFF

SEQ ID NO: 2094 - protein, 16 aa, Homo sapiens
CASSSEGLSGANVLTF

SEQ ID NO: 2095 - protein, 14 aa, Homo sapiens
CASSSGQGTYEQYF

SEQ ID NO: 2096 - protein, 16 aa, Homo sapiens
CASSSGTDFSTDTQYF

SEQ ID NO: 2097 - protein, 15 aa, Homo sapiens
CASSSIAGAGNEQFF

SEQ ID NO: 2098 - protein, 12 aa, Homo sapiens
CASSSISETQYF

SEQ ID NO: 2099 - protein, 17 aa, Homo sapiens
CASSSIVSRPSTDTQYF

SEQ ID NO: 2100 - protein, 17 aa, Homo sapiens
CASSSLLAGIDTGELFF

SEQ ID NO: 2101 - protein, 15 aa, Homo sapiens
CASSSPGQGTYEQYF

SEQ ID NO: 2102 - protein, 13 aa, Homo sapiens
CASSSPPSNEQFF

SEQ ID NO: 2103 - protein, 16 aa, Homo sapiens
CASSSPTSGTSYEQYF

SEQ ID NO: 2104 - protein, 15 aa, Homo sapiens
CASSSQREGLYEQYF

SEQ ID NO: 2105 - protein, 13 aa, Homo sapiens
CASSSSEAYEQYF

SEQ ID NO: 2106 - protein, 14 aa, Homo sapiens
CASSSSGAYNEQFF

SEQ ID NO: 2107 - protein, 16 aa, Homo sapiens
CASSSSKRILNTEAFF

SEQ ID NO: 2108 - protein, 15 aa, Homo sapiens
CASSSTSGSPDTQYF

SEQ ID NO: 2109 - protein, 16 aa, Homo sapiens
CASSSTSVSSYNEQFF

SEQ ID NO: 2110 - protein, 13 aa, Homo sapiens
CASSTRTEETQYF

SEQ ID NO: 2111 - protein, 14 aa, Homo sapiens
CASSTSGAYNEQFF

SEQ ID NO: 2112 - protein, 16 aa, Homo sapiens
CASSTTSGRNTGELFF

SEQ ID NO: 2113 - protein, 14 aa, Homo sapiens
CASSVAGSTDTQYF

SEQ ID NO: 2114 - protein, 11 aa, Homo sapiens
CASSVGEEQYF

SEQ ID NO: 2115 - protein, 15 aa, Homo sapiens
CASSWAGTGGYGYTF

SEQ ID NO: 2116 - protein, 13 aa, Homo sapiens
CASSWDRVYEQFF

SEQ ID NO: 2117 - protein, 17 aa, Homo sapiens
CASSWGGAYSSQETQYF

SEQ ID NO: 2118 - protein, 16 aa, Homo sapiens
CASSWGGRETYNEQFF

SEQ ID NO: 2119 - protein, 14 aa, Homo sapiens
CASSWGTGAGEQFF

SEQ ID NO: 2120 - protein, 14 aa, Homo sapiens
CASSWGTGSGDQFF

SEQ ID NO: 2121 - protein, 14 aa, Homo sapiens
CASSWGTGSGEQFF

SEQ ID NO: 2122 - protein, 16 aa, Homo sapiens
CASSWKGRRRTDTQYF

SEQ ID NO: 2123 - protein, 14 aa, Homo sapiens
CASSWSAANYGYTF

SEQ ID NO: 2124 - protein, 13 aa, Homo sapiens
CASSYGGFYEQYF

SEQ ID NO: 2125 - protein, 13 aa, Homo sapiens
CASSYGTATEAFF

SEQ ID NO: 2126 - protein, 14 aa, Homo sapiens
CASSYGTGSTEAFF

SEQ ID NO: 2127 - protein, 12 aa, Homo sapiens
CASSYLNQPQHF

SEQ ID NO: 2128 - protein, 15 aa, Homo sapiens
CASTKTGLKGETQYF

SEQ ID NO: 2129 - protein, 14 aa, Homo sapiens
CASTLAGAYNEQFF

SEQ ID NO: 2130 - protein, 14 aa, Homo sapiens
CASTPGGGYNEQFF

SEQ ID NO: 2131 - protein, 14 aa, Homo sapiens
CASTPRGSLGELFF

SEQ ID NO: 2132 - protein, 15 aa, Homo sapiens
CATSFGDRAYNDQFF

SEQ ID NO: 2133 - protein, 15 aa, Homo sapiens
CATSFGDRAYNEQFF

SEQ ID NO: 2134 - protein, 14 aa, Homo sapiens
CAVRTEGAINEQFF

SEQ ID NO: 2135 - protein, 13 aa, Homo sapiens
CAGSGTENTEAFF

SEQ ID NO: 2136 - protein, 12 aa, Homo sapiens
CAIRGDTYEQYF

SEQ ID NO: 2137 - protein, 14 aa, Homo sapiens
CAISSQGLENEQYF

SEQ ID NO: 2138 - protein, 14 aa, Homo sapiens
CASAIAGGINEQFF

SEQ ID NO: 2139 - protein, 17 aa, Homo sapiens
CASAKRVGLADYNEQFF

SEQ ID NO: 2140 - protein, 15 aa, Homo sapiens
CASASGGDSSYEQYF

SEQ ID NO: 2141 - protein, 7 aa, Homo sapiens
CASEAFF

SEQ ID NO: 2142 - protein, 12 aa, Homo sapiens
CASEAVNEKLFF

SEQ ID NO: 2143 - protein, 12 aa, Homo sapiens
CASGAGLMTQYF

SEQ ID NO: 2144 - protein, 12 aa, Homo sapiens
CASGDRANEQYF

SEQ ID NO: 2145 - protein, 13 aa, Homo sapiens
CASGGTGGYGYTF

SEQ ID NO: 2146 - protein, 16 aa, Homo sapiens
CASGSPGTSGGNEQFF

SEQ ID NO: 2147 - protein, 15 aa, Homo sapiens
CASIDRTGPGETQYF

SEQ ID NO: 2148 - protein, 15 aa, Homo sapiens
CASIGLAGGIDTQYF

SEQ ID NO: 2149 - protein, 13 aa, Homo sapiens
CASKGPGAEAHYF

SEQ ID NO: 2150 - protein, 13 aa, Homo sapiens
CASKGPGAEAQYF

SEQ ID NO: 2151 - protein, 15 aa, Homo sapiens
CASKLGQVPGQPQHF

SEQ ID NO: 2152 - protein, 14 aa, Homo sapiens
CASKLTTATYEQYF

SEQ ID NO: 2153 - protein, 15 aa, Homo sapiens
CASKSYRGNTGELFF

SEQ ID NO: 2154 - protein, 14 aa, Homo sapiens
CASKYRGPTYEQYF

SEQ ID NO: 2155 - protein, 13 aa, Homo sapiens
CASLQGNTYEQYF

SEQ ID NO: 2156 - protein, 14 aa, Homo sapiens
CASLSYRDYGELFF

SEQ ID NO: 2157 - protein, 16 aa, Homo sapiens
CASMSGPLSYTGELFF

SEQ ID NO: 2158 - protein, 16 aa, Homo sapiens
CASMSGPMTYTFELCF

SEQ ID NO: 2159 - protein, 15 aa, Homo sapiens
CASNPLGGGVETQYF

SEQ ID NO: 2160 - protein, 14 aa, Homo sapiens
CASRATGGRQPQHF

SEQ ID NO: 2161 - protein, 15 aa, Homo sapiens
CASREGGQPLDTQYF

SEQ ID NO: 2162 - protein, 12 aa, Homo sapiens
CASRGGIYGYTF

SEQ ID NO: 2163 - protein, 10 aa, Homo sapiens
CASRLETQYF

SEQ ID NO: 2164 - protein, 14 aa, Homo sapiens
CASRLLAGYNDQFF

SEQ ID NO: 2165 - protein, 13 aa, Homo sapiens
CASRPDERDTQYF

SEQ ID NO: 2166 - protein, 14 aa, Homo sapiens
CASRPGAPLNIQYF

SEQ ID NO: 2167 - protein, 17 aa, Homo sapiens
CASRQALAGGLTDEQFF

SEQ ID NO: 2168 - protein, 13 aa, Homo sapiens
CASRRDPYNEQFF

SEQ ID NO: 2169 - protein, 14 aa, Homo sapiens
CASRRIEGTGELFF

SEQ ID NO: 2170 - protein, 13 aa, Homo sapiens
CASRSRASYEQYF

SEQ ID NO: 2171 - protein, 16 aa, Homo sapiens
CASRSTSGSSYNEQFF

SEQ ID NO: 2172 - protein, 15 aa, Homo sapiens
CASRTLGTGSDTQYF

SEQ ID NO: 2173 - protein, 16 aa, Homo sapiens
CASRVKRGLAEDTQYF

SEQ ID NO: 2174 - protein, 14 aa, Homo sapiens
CASRVNRAEYGYTF

SEQ ID NO: 2175 - protein, 13 aa, Homo sapiens
CASSADREYEQYF

SEQ ID NO: 2176 - protein, 14 aa, Homo sapiens
CASSALERYNEQFF

SEQ ID NO: 2177 - protein, 11 aa, Homo sapiens
CASSARDEQYF

SEQ ID NO: 2178 - protein, 14 aa, Homo sapiens
CASSARDGAYEQYF

SEQ ID NO: 2179 - protein, 14 aa, Homo sapiens
CASSCTGLRDTQYF

SEQ ID NO: 2180 - protein, 14 aa, Homo sapiens
CASSDAESADQHYF

SEQ ID NO: 2181 - protein, 14 aa, Homo sapiens
CASSDEDSADQHYF

SEQ ID NO: 2182 - protein, 14 aa, Homo sapiens
CASSDEESADQQYF

SEQ ID NO: 2183 - protein, 15 aa, Homo sapiens
CASSDFGGGANVLTF

SEQ ID NO: 2184 - protein, 14 aa, Homo sapiens
CASSDGDRTYHQYF

SEQ ID NO: 2185 - protein, 16 aa, Homo sapiens
CASSDGGWGSYNEQFF

SEQ ID NO: 2186 - protein, 12 aa, Homo sapiens
CASSDLFEKLFF

SEQ ID NO: 2187 - protein, 15 aa, Homo sapiens
CASSDPPAGFDIQYF

SEQ ID NO: 2188 - protein, 17 aa, Homo sapiens
CASSDRGPISGANVLTF

SEQ ID NO: 2189 - protein, 12 aa, Homo sapiens
CASSDSANEQFF

SEQ ID NO: 2190 - protein, 15 aa, Homo sapiens
CASSDSSPNTGELFF

SEQ ID NO: 2191 - protein, 13 aa, Homo sapiens
CASSDTENTEDFF

SEQ ID NO: 2192 - protein, 15 aa, Homo sapiens
CASSEAEGASYEQYF

SEQ ID NO: 2193 - protein, 17 aa, Homo sapiens
CASSEAFGGALGQPQHF

SEQ ID NO: 2194 - protein, 12 aa, Homo sapiens
CASSEAGVELFF

SEQ ID NO: 2195 - protein, 16 aa, Homo sapiens
CASSEAQGGPTDTQYF

SEQ ID NO: 2196 - protein, 16 aa, Homo sapiens
CASSEAQGGRTDTQFF

SEQ ID NO: 2197 - protein, 17 aa, Homo sapiens
CASSEARDRLAVYGYTF

SEQ ID NO: 2198 - protein, 15 aa, Homo sapiens
CASSEASGSSYEQYF

SEQ ID NO: 2199 - protein, 16 aa, Homo sapiens
CASSEDPPGLAAEQYF

SEQ ID NO: 2200 - protein, 17 aa, Homo sapiens
CASSEDSLAGQNNEQFF

SEQ ID NO: 2201 - protein, 16 aa, Homo sapiens
CASSEDTGTGSYEQYF

SEQ ID NO: 2202 - protein, 16 aa, Homo sapiens
CASSEERDRGQDEYYF

SEQ ID NO: 2203 - protein, 16 aa, Homo sapiens
CASSEEVNPGANVLTF

SEQ ID NO: 2204 - protein, 16 aa, Homo sapiens
CASSEFSSGGKHGYTF

SEQ ID NO: 2205 - protein, 16 aa, Homo sapiens
CASSEGDSSGANVLTF

SEQ ID NO: 2206 - protein, 14 aa, Homo sapiens
CASSEGDSPYEQYF

SEQ ID NO: 2207 - protein, 20 aa, Homo sapiens
CASSEGGASQVSGVKNIQYF

SEQ ID NO: 2208 - protein, 15 aa, Homo sapiens
CASSEGQVSQETQYF

SEQ ID NO: 2209 - protein, 15 aa, Homo sapiens
CASSELAGDTDTQYF

SEQ ID NO: 2210 - protein, 16 aa, Homo sapiens
CASSELAGGPQETQYF

SEQ ID NO: 2211 - protein, 17 aa, Homo sapiens
CASSELGRFSGANVLTF

SEQ ID NO: 2212 - protein, 15 aa, Homo sapiens
CASSERAGGSETQYF

SEQ ID NO: 2213 - protein, 14 aa, Homo sapiens
CASSERGPNQPQHF

SEQ ID NO: 2214 - protein, 15 aa, Homo sapiens
CASSERTGGNTEAFF

SEQ ID NO: 2215 - protein, 13 aa, Homo sapiens
CASSETDNTEAFF

SEQ ID NO: 2216 - protein, 14 aa, Homo sapiens
CASSETDRGHEQYF

SEQ ID NO: 2217 - protein, 14 aa, Homo sapiens
CASSETGGYGEQYF

SEQ ID NO: 2218 - protein, 13 aa, Homo sapiens
CASSETISYEQYF

SEQ ID NO: 2219 - protein, 14 aa, Homo sapiens
CASSETSGRETDFF

SEQ ID NO: 2220 - protein, 15 aa, Homo sapiens
CASSEVSGSGNTIYF

SEQ ID NO: 2221 - protein, 15 aa, Homo sapiens
CASSFLTDFQETQYF

SEQ ID NO: 2222 - protein, 14 aa, Homo sapiens
CASSFPGVVETQYF

SEQ ID NO: 2223 - protein, 15 aa, Homo sapiens
CASSGEREGRYEQYF

SEQ ID NO: 2224 - protein, 14 aa, Homo sapiens
CASSGLADYNEQFF

SEQ ID NO: 2225 - protein, 14 aa, Homo sapiens
CASSGQPMNTEAFF

SEQ ID NO: 2226 - protein, 15 aa, Homo sapiens
CASSGRDTAAYEQYF

SEQ ID NO: 2227 - protein, 13 aa, Homo sapiens
CASSGTENTEAFF

SEQ ID NO: 2228 - protein, 15 aa, Homo sapiens
CASSHAHEGADTQYF

SEQ ID NO: 2229 - protein, 15 aa, Homo sapiens
CASSHLGDGTDTQYF

SEQ ID NO: 2230 - protein, 13 aa, Homo sapiens
CASSHNPNYGYTF

SEQ ID NO: 2231 - protein, 17 aa, Homo sapiens
CASSHRGRGDPHTFGFF

SEQ ID NO: 2232 - protein, 14 aa, Homo sapiens
CASSHSRSGDHLSF

SEQ ID NO: 2233 - protein, 14 aa, Homo sapiens
CASSIDSQAGELFF

SEQ ID NO: 2234 - protein, 15 aa, Homo sapiens
CASSISGSHSYEQYF

SEQ ID NO: 2235 - protein, 14 aa, Homo sapiens
CASSISRIGDNLYF

SEQ ID NO: 2236 - protein, 14 aa, Homo sapiens
CASSISRTGDNLYF

SEQ ID NO: 2237 - protein, 15 aa, Homo sapiens
CASSKGAGAAYGYTF

SEQ ID NO: 2238 - protein, 15 aa, Homo sapiens
CASSKYPGGRNTIYF

SEQ ID NO: 2239 - protein, 13 aa, Homo sapiens
CASSLAGVYEQYF

SEQ ID NO: 2240 - protein, 15 aa, Homo sapiens
CASSLGLAGNNEQFF

SEQ ID NO: 2241 - protein, 14 aa, Homo sapiens
CASSLGQGANTIYF

SEQ ID NO: 2242 - protein, 14 aa, Homo sapiens
CASSLGQHQETQYF

SEQ ID NO: 2243 - protein, 14 aa, Homo sapiens
CASSLGTPRDEQFF

SEQ ID NO: 2244 - protein, 16 aa, Homo sapiens
CASSLIRQGWGYGYTF

SEQ ID NO: 2245 - protein, 15 aa, Homo sapiens
CASSLLAGENDEQYF

SEQ ID NO: 2246 - protein, 10 aa, Homo sapiens
CASSLRTQHF

SEQ ID NO: 2247 - protein, 14 aa, Homo sapiens
CASSLSGTGDNLSF

SEQ ID NO: 2248 - protein, 13 aa, Homo sapiens
CASSLSSYNEQFF

SEQ ID NO: 2249 - protein, 14 aa, Homo sapiens
CASSNRGPNQPQHF

SEQ ID NO: 2250 - protein, 14 aa, Homo sapiens
CASSPAGEGYEQYF

SEQ ID NO: 2251 - protein, 13 aa, Homo sapiens
CASSPDRAETQYF

SEQ ID NO: 2252 - protein, 16 aa, Homo sapiens
CASSPESVRGGNTIYF

SEQ ID NO: 2253 - protein, 12 aa, Homo sapiens
CASSPGANVLTF

SEQ ID NO: 2254 - protein, 14 aa, Homo sapiens
CASSPGGGDDYQYF

SEQ ID NO: 2255 - protein, 12 aa, Homo sapiens
CASSPGGGKLFF

SEQ ID NO: 2256 - protein, 14 aa, Homo sapiens
CASSPGGGNDHQYF

SEQ ID NO: 2257 - protein, 14 aa, Homo sapiens
CASSPGGGNYQQYF

SEQ ID NO: 2258 - protein, 15 aa, Homo sapiens
CASSPGPGPGNEQFF

SEQ ID NO: 2259 - protein, 15 aa, Homo sapiens
CASSPGQGGINEQFF

SEQ ID NO: 2260 - protein, 14 aa, Homo sapiens
CASSPGQGNYEQYF

SEQ ID NO: 2261 - protein, 14 aa, Homo sapiens
CASSPGQGNYKQYF

SEQ ID NO: 2262 - protein, 15 aa, Homo sapiens
CASSPGTGIYNEQFF

SEQ ID NO: 2263 - protein, 16 aa, Homo sapiens
CASSPIAGGPGDTQYF

SEQ ID NO: 2264 - protein, 16 aa, Homo sapiens
CASSPINRGHQETQYF

SEQ ID NO: 2265 - protein, 16 aa, Homo sapiens
CASSPKAAGINEKLFF

SEQ ID NO: 2266 - protein, 15 aa, Homo sapiens
CASSPLAEPTDTQYF

SEQ ID NO: 2267 - protein, 16 aa, Homo sapiens
CASSPLSGRHADTQYF

SEQ ID NO: 2268 - protein, 15 aa, Homo sapiens
CASSPPGPKIDTQYF

SEQ ID NO: 2269 - protein, 14 aa, Homo sapiens
CASSPSGLLAPQHF

SEQ ID NO: 2270 - protein, 15 aa, Homo sapiens
CASSPSTGSLGEQYF

SEQ ID NO: 2271 - protein, 15 aa, Homo sapiens
CASSPTGTGAGEQYF

SEQ ID NO: 2272 - protein, 16 aa, Homo sapiens
CASSQGQGRLTDTQYF

SEQ ID NO: 2273 - protein, 15 aa, Homo sapiens
CASSQKPGPWEVETF

SEQ ID NO: 2274 - protein, 15 aa, Homo sapiens
CASSRLEGLYNEQFF

SEQ ID NO: 2275 - protein, 13 aa, Homo sapiens
CASSRTSIHEQFF

SEQ ID NO: 2276 - protein, 12 aa, Homo sapiens
CASSRTSVRALF

SEQ ID NO: 2277 - protein, 11 aa, Homo sapiens
CASSSAWEQYF

SEQ ID NO: 2278 - protein, 14 aa, Homo sapiens
CASSSERARCQQYF

SEQ ID NO: 2279 - protein, 13 aa, Homo sapiens
CASSSGATYEQYF

SEQ ID NO: 2280 - protein, 13 aa, Homo sapiens
CASSSGGTYEQYF

SEQ ID NO: 2281 - protein, 14 aa, Homo sapiens
CASSSGHMNTEAFF

SEQ ID NO: 2282 - protein, 14 aa, Homo sapiens
CASSSGLGFNEQFF

SEQ ID NO: 2283 - protein, 16 aa, Homo sapiens
CASSSGQGGSYNDQFF

SEQ ID NO: 2284 - protein, 15 aa, Homo sapiens
CASSSGTGAGETQYF

SEQ ID NO: 2285 - protein, 17 aa, Homo sapiens
CASSSGTSGDFYNEQFF

SEQ ID NO: 2286 - protein, 14 aa, Homo sapiens
CASSSLPLADTQYF

SEQ ID NO: 2287 - protein, 19 aa, Homo sapiens
CASSSLSGTSGKTGYEQYF

SEQ ID NO: 2288 - protein, 14 aa, Homo sapiens
CASSSSVNGNTIYF

SEQ ID NO: 2289 - protein, 13 aa, Homo sapiens
CASSSTGDTEAFF

SEQ ID NO: 2290 - protein, 13 aa, Homo sapiens
CASSTGFRDTQYF

SEQ ID NO: 2291 - protein, 13 aa, Homo sapiens
CASSTTGGKGYTF

SEQ ID NO: 2292 - protein, 17 aa, Homo sapiens
CASSVKGLVREYNEQFF

SEQ ID NO: 2293 - protein, 14 aa, Homo sapiens
CASSVPGLAGEQFF

SEQ ID NO: 2294 - protein, 14 aa, Homo sapiens
CASSVQNSYNEQFF

SEQ ID NO: 2295 - protein, 13 aa, Homo sapiens
CASSVRENTEAFF

SEQ ID NO: 2296 - protein, 14 aa, Homo sapiens
CASSWAGTTNEQFF

SEQ ID NO: 2297 - protein, 13 aa, Homo sapiens
CASSWGMGETQYF

SEQ ID NO: 2298 - protein, 14 aa, Homo sapiens
CASSWRTSGYEQYF

SEQ ID NO: 2299 - protein, 14 aa, Homo sapiens
CASSWTGLTDTQYF

SEQ ID NO: 2300 - protein, 15 aa, Homo sapiens
CASSYADREVQPQHF

SEQ ID NO: 2301 - protein, 16 aa, Homo sapiens
CASSYADTFSYNEQFF

SEQ ID NO: 2302 - protein, 12 aa, Homo sapiens
CASSYAGAEQFF

SEQ ID NO: 2303 - protein, 15 aa, Homo sapiens
CASSYATGEGSPLHF

SEQ ID NO: 2304 - protein, 17 aa, Homo sapiens
CASSYAYRETTNEKLFF

SEQ ID NO: 2305 - protein, 14 aa, Homo sapiens
CASSYFEMEETQYF

SEQ ID NO: 2306 - protein, 13 aa, Homo sapiens
CASSYFLNTEAFF

SEQ ID NO: 2307 - protein, 18 aa, Homo sapiens
CASSYFSPGLAGEETQYF

SEQ ID NO: 2308 - protein, 14 aa, Homo sapiens
CASSYGAGGYEQYF

SEQ ID NO: 2309 - protein, 16 aa, Homo sapiens
CASSYGAPPQYNEQFF

SEQ ID NO: 2310 - protein, 15 aa, Homo sapiens
CASSYGASGSDTYYF

SEQ ID NO: 2311 - protein, 14 aa, Homo sapiens
CASSYGDYSYEQYF

SEQ ID NO: 2312 - protein, 14 aa, Homo sapiens
CASSYGDYSYQQYF

SEQ ID NO: 2313 - protein, 16 aa, Homo sapiens
CASSYGLAVNTGELFF

SEQ ID NO: 2314 - protein, 15 aa, Homo sapiens
CASSYGQTINYGYTF

SEQ ID NO: 2315 - protein, 16 aa, Homo sapiens
CASSYGRAREPLWWYF

SEQ ID NO: 2316 - protein, 14 aa, Homo sapiens
CASSYGRSNYGYTF

SEQ ID NO: 2317 - protein, 13 aa, Homo sapiens
CASSYGRVNEQFF

SEQ ID NO: 2318 - protein, 13 aa, Homo sapiens
CASSYGSTYEQYF

SEQ ID NO: 2319 - protein, 16 aa, Homo sapiens
CASSYGTGEVTGELFF

SEQ ID NO: 2320 - protein, 16 aa, Homo sapiens
CASSYGTGTIHSPLHF

SEQ ID NO: 2321 - protein, 15 aa, Homo sapiens
CASSYGTSASHTHFF

SEQ ID NO: 2322 - protein, 15 aa, Homo sapiens
CASSYGTSGSDTQYF

SEQ ID NO: 2323 - protein, 12 aa, Homo sapiens
CASSYGVYEQYF

SEQ ID NO: 2324 - protein, 13 aa, Homo sapiens
CASSYIQNSPLHF

SEQ ID NO: 2325 - protein, 15 aa, Homo sapiens
CASSYLAGNTDTQYF

SEQ ID NO: 2326 - protein, 15 aa, Homo sapiens
CASSYLGGSNTEAFF

SEQ ID NO: 2327 - protein, 13 aa, Homo sapiens
CASSYLGQGEQYF

SEQ ID NO: 2328 - protein, 18 aa, Homo sapiens
CASSYLTLAGGPQETQYF

SEQ ID NO: 2329 - protein, 17 aa, Homo sapiens
CASSYNPTSGAKNIQYF

SEQ ID NO: 2330 - protein, 17 aa, Homo sapiens
CASSYPGQGAHTGELFF

SEQ ID NO: 2331 - protein, 14 aa, Homo sapiens
CASSYQDRGYEQYF

SEQ ID NO: 2332 - protein, 16 aa, Homo sapiens
CASSYQGWGPNQPQHF

SEQ ID NO: 2333 - protein, 11 aa, Homo sapiens
CASSYRDEQFF

SEQ ID NO: 2334 - protein, 14 aa, Homo sapiens
CASSYRDLPYQQYF

SEQ ID NO: 2335 - protein, 15 aa, Homo sapiens
CASSYRDSYYNEQFF

SEQ ID NO: 2336 - protein, 14 aa, Homo sapiens
CASSYRDVAYEQYF

SEQ ID NO: 2337 - protein, 14 aa, Homo sapiens
CASSYRDVPYEQYF

SEQ ID NO: 2338 - protein, 14 aa, Homo sapiens
CASSYRDVPYQQYF

SEQ ID NO: 2339 - protein, 14 aa, Homo sapiens
CASSYRGQGNEQYF

SEQ ID NO: 2340 - protein, 15 aa, Homo sapiens
CASSYRGRVLDEQYF

SEQ ID NO: 2341 - protein, 15 aa, Homo sapiens
CASSYRQDSNQPQHF

SEQ ID NO: 2342 - protein, 14 aa, Homo sapiens
CASSYRQGTYEQYF

SEQ ID NO: 2343 - protein, 17 aa, Homo sapiens
CASSYRQYTSDGYEQYF

SEQ ID NO: 2344 - protein, 14 aa, Homo sapiens
CASSYRWGVDTQYF

SEQ ID NO: 2345 - protein, 12 aa, Homo sapiens
CASSYSAGEQFF

SEQ ID NO: 2346 - protein, 12 aa, Homo sapiens
CASSYSDETQYF

SEQ ID NO: 2347 - protein, 16 aa, Homo sapiens
CASSYSGDSQVSPLHF

SEQ ID NO: 2348 - protein, 18 aa, Homo sapiens
CASSYSGGEREGRDEQFF

SEQ ID NO: 2349 - protein, 15 aa, Homo sapiens
CASSYSGGNGNTIYF

SEQ ID NO: 2350 - protein, 14 aa, Homo sapiens
CASSYSGPLYEQYF

SEQ ID NO: 2351 - protein, 14 aa, Homo sapiens
CASSYSGRGYDYSF

SEQ ID NO: 2352 - protein, 16 aa, Homo sapiens
CASSYSGRRPLDEQYF

SEQ ID NO: 2353 - protein, 17 aa, Homo sapiens
CASSYSKAGGRGNTIYF

SEQ ID NO: 2354 - protein, 15 aa, Homo sapiens
CASSYSLGGSTEAFF

SEQ ID NO: 2355 - protein, 14 aa, Homo sapiens
CASSYSPDTDTQYF

SEQ ID NO: 2356 - protein, 16 aa, Homo sapiens
CASSYSPTSGPWEQYF

SEQ ID NO: 2357 - protein, 14 aa, Homo sapiens
CASSYSQGENEQFF

SEQ ID NO: 2358 - protein, 15 aa, Homo sapiens
CASSYSQLANYGYTF

SEQ ID NO: 2359 - protein, 16 aa, Homo sapiens
CASSYSQRDDPYEQYF

SEQ ID NO: 2360 - protein, 16 aa, Homo sapiens
CASSYSRDRPSYNEQF

SEQ ID NO: 2361 - protein, 15 aa, Homo sapiens
CASSYSRENTGELFF

SEQ ID NO: 2362 - protein, 15 aa, Homo sapiens
CASSYSRQGENIQYF

SEQ ID NO: 2363 - protein, 15 aa, Homo sapiens
CASSYSRQGGQPQHF

SEQ ID NO: 2364 - protein, 15 aa, Homo sapiens
CASSYSRVAGFNEQF

SEQ ID NO: 2365 - protein, 13 aa, Homo sapiens
CASSYSRYNEQFF

SEQ ID NO: 2366 - protein, 13 aa, Homo sapiens
CASSYSSGTEAFF

SEQ ID NO: 2367 - protein, 16 aa, Homo sapiens
CASSYSSSDSSYEQYF

SEQ ID NO: 2368 - protein, 18 aa, Homo sapiens
CASSYSSVPTGLSYGYTF

SEQ ID NO: 2369 - protein, 14 aa, Homo sapiens
CASSYSTESREQYF

SEQ ID NO: 2370 - protein, 15 aa, Homo sapiens
CASSYSVGTESPLHF

SEQ ID NO: 2371 - protein, 14 aa, Homo sapiens
CASSYSVSNQPQHF

SEQ ID NO: 2372 - protein, 18 aa, Homo sapiens
CASSYTPQSSGRSGEQFF

SEQ ID NO: 2373 - protein, 13 aa, Homo sapiens
CASSYVGGTEAFF

SEQ ID NO: 2374 - protein, 14 aa, Homo sapiens
CASSYVTTKETQYF

SEQ ID NO: 2375 - protein, 14 aa, Homo sapiens
CASSYWEGAYEQYF

SEQ ID NO: 2376 - protein, 15 aa, Homo sapiens
CASSYYGRETGELFF

SEQ ID NO: 2377 - protein, 13 aa, Homo sapiens
CASTAGTYNEQFF

SEQ ID NO: 2378 - protein, 15 aa, Homo sapiens
CASTDFYGGRHGYTF

SEQ ID NO: 2379 - protein, 16 aa, Homo sapiens
CASTDPLTGMNTEAFF

SEQ ID NO: 2380 - protein, 13 aa, Homo sapiens
CASTEDPREPQHF

SEQ ID NO: 2381 - protein, 17 aa, Homo sapiens
CASTHRGKGDSDTLGFF

SEQ ID NO: 2382 - protein, 12 aa, Homo sapiens
CASTLTGYGYTF

SEQ ID NO: 2383 - protein, 16 aa, Homo sapiens
CASTMLAGVETGELFF

SEQ ID NO: 2384 - protein, 14 aa, Homo sapiens
CASTPLGTSGEQFF

SEQ ID NO: 2385 - protein, 14 aa, Homo sapiens
CASTPRERPSEQYF

SEQ ID NO: 2386 - protein, 15 aa, Homo sapiens
CASTPSGAWQETQYF

SEQ ID NO: 2387 - protein, 12 aa, Homo sapiens
CASTQGGAELFF

SEQ ID NO: 2388 - protein, 14 aa, Homo sapiens
CASTRDSSTDTQYF

SEQ ID NO: 2389 - protein, 17 aa, Homo sapiens
CASTRPGQGASDTEAFF

SEQ ID NO: 2390 - protein, 12 aa, Homo sapiens
CASTSGLRELFF

SEQ ID NO: 2391 - protein, 13 aa, Homo sapiens
CASTTGLNTEAFF

SEQ ID NO: 2392 - protein, 14 aa, Homo sapiens
CASTVGQGAWEQYF

SEQ ID NO: 2393 - protein, 14 aa, Homo sapiens
CASWDALDPDTQYF

SEQ ID NO: 2394 - protein, 14 aa, Homo sapiens
CATEGRLVNTEAFF

SEQ ID NO: 2395 - protein, 15 aa, Homo sapiens
CAISISAGSPDTQYF

SEQ ID NO: 2396 - protein, 16 aa, Homo sapiens
CAPRNRTGGDLHEQYF

SEQ ID NO: 2397 - protein, 13 aa, Homo sapiens
CASGRSSYNEQFF

SEQ ID NO: 2398 - protein, 13 aa, Homo sapiens
CASRFEGGETQYF

SEQ ID NO: 2399 - protein, 14 aa, Homo sapiens
CASRGQGNTGELFF

SEQ ID NO: 2400 - protein, 13 aa, Homo sapiens
CASRTGNWETQYF

SEQ ID NO: 2401 - protein, 13 aa, Homo sapiens
CASSEGAAYEQYF

SEQ ID NO: 2402 - protein, 15 aa, Homo sapiens
CASSFLAGVLNEQFF

SEQ ID NO: 2403 - protein, 15 aa, Homo sapiens
CASSFMASSYNEQFF

SEQ ID NO: 2404 - protein, 14 aa, Homo sapiens
CASSFNGRTGELFF

SEQ ID NO: 2405 - protein, 16 aa, Homo sapiens
CASSFRQGSDTGELFF

SEQ ID NO: 2406 - protein, 13 aa, Homo sapiens
CASSGVLVDTQYF

SEQ ID NO: 2407 - protein, 13 aa, Homo sapiens
CASSHGGSDTQYF

SEQ ID NO: 2408 - protein, 16 aa, Homo sapiens
CASSHIAGGSYNEQFF

SEQ ID NO: 2409 - protein, 13 aa, Homo sapiens
CASSLAGGHGYTF

SEQ ID NO: 2410 - protein, 14 aa, Homo sapiens
CASSLALGGPEQYF

SEQ ID NO: 2411 - protein, 19 aa, Homo sapiens
CASSLALGLAGGPTDTQYF

SEQ ID NO: 2412 - protein, 17 aa, Homo sapiens
CASSLASDRAPENEQFF

SEQ ID NO: 2413 - protein, 14 aa, Homo sapiens
CASSLDGGGGGYTF

SEQ ID NO: 2414 - protein, 15 aa, Homo sapiens
CASSLDGRDVDTQYF

SEQ ID NO: 2415 - protein, 13 aa, Homo sapiens
CASSLDPQETQYF

SEQ ID NO: 2416 - protein, 14 aa, Homo sapiens
CASSLDRNTGELFF

SEQ ID NO: 2417 - protein, 17 aa, Homo sapiens
CASSLDRWDGSTDTQYF

SEQ ID NO: 2418 - protein, 13 aa, Homo sapiens
CASSLDWNQPQHF

SEQ ID NO: 2419 - protein, 14 aa, Homo sapiens
CASSLEDSYNEQFF

SEQ ID NO: 2420 - protein, 15 aa, Homo sapiens
CASSLELIVEETQYF

SEQ ID NO: 2421 - protein, 15 aa, Homo sapiens
CASSLELSVEETQYF

SEQ ID NO: 2422 - protein, 15 aa, Homo sapiens
CASSLEVALDYEQYF

SEQ ID NO: 2423 - protein, 14 aa, Homo sapiens
CASSLFAGADTQYF

SEQ ID NO: 2424 - protein, 15 aa, Homo sapiens
CASSLFPSDYNEQFF

SEQ ID NO: 2425 - protein, 13 aa, Homo sapiens
CASSLGGGEKLFF

SEQ ID NO: 2426 - protein, 12 aa, Homo sapiens
CASSLGGNEQFF

SEQ ID NO: 2427 - protein, 12 aa, Homo sapiens
CASSLGGTEAFF

SEQ ID NO: 2428 - protein, 14 aa, Homo sapiens
CASSLGQGANEQYF

SEQ ID NO: 2429 - protein, 17 aa, Homo sapiens
CASSLGRETGEVYGYTF

SEQ ID NO: 2430 - protein, 13 aa, Homo sapiens
CASSLGTSDEQFF

SEQ ID NO: 2431 - protein, 13 aa, Homo sapiens
CASSLGYVSEQYF

SEQ ID NO: 2432 - protein, 16 aa, Homo sapiens
CASSLIGVSVYNEQFF

SEQ ID NO: 2433 - protein, 13 aa, Homo sapiens
CASSLKVLGEAFF

SEQ ID NO: 2434 - protein, 15 aa, Homo sapiens
CASSLLGGYGNTIYF

SEQ ID NO: 2435 - protein, 18 aa, Homo sapiens
CASSLMESGLVGRDTQYF

SEQ ID NO: 2436 - protein, 13 aa, Homo sapiens
CASSLMGGHEQFF

SEQ ID NO: 2437 - protein, 16 aa, Homo sapiens
CASSLMGGTGNEKLFF

SEQ ID NO: 2438 - protein, 16 aa, Homo sapiens
CASSLNPGLAEETQYF

SEQ ID NO: 2439 - protein, 18 aa, Homo sapiens
CASSLNPLARGTDNEQFF

SEQ ID NO: 2440 - protein, 17 aa, Homo sapiens
CASSLRGWTSDTDTQYF

SEQ ID NO: 2441 - protein, 15 aa, Homo sapiens
CASSLSAAGANVLTF

SEQ ID NO: 2442 - protein, 15 aa, Homo sapiens
CASSLSAGSPDTQYF

SEQ ID NO: 2443 - protein, 15 aa, Homo sapiens
CASSLSSGSIDEQFF

SEQ ID NO: 2444 - protein, 15 aa, Homo sapiens
CASSLTGGRADTQYF

SEQ ID NO: 2445 - protein, 15 aa, Homo sapiens
CASSLTGTGVYEQYF

SEQ ID NO: 2446 - protein, 16 aa, Homo sapiens
CASSLTSGSSYNEQFF

SEQ ID NO: 2447 - protein, 14 aa, Homo sapiens
CASSLVDGTYEQYF

SEQ ID NO: 2448 - protein, 20 aa, Homo sapiens
CASSLVPPGLAGVEGYEQYF

SEQ ID NO: 2449 - protein, 14 aa, Homo sapiens
CASSLVQAQETQYF

SEQ ID NO: 2450 - protein, 18 aa, Homo sapiens
CASSLWETGKSTTGELFF

SEQ ID NO: 2451 - protein, 18 aa, Homo sapiens
CASSLYFGGLAGPGELFF

SEQ ID NO: 2452 - protein, 16 aa, Homo sapiens
CASSMGLAETLYEQYF

SEQ ID NO: 2453 - protein, 16 aa, Homo sapiens
CASSPDPHRGIHEQYF

SEQ ID NO: 2454 - protein, 12 aa, Homo sapiens
CASSPDYNEQFF

SEQ ID NO: 2455 - protein, 16 aa, Homo sapiens
CASSPGTSGRVNEQFF

SEQ ID NO: 2456 - protein, 16 aa, Homo sapiens
CASSPIGSESGNTIYF

SEQ ID NO: 2457 - protein, 16 aa, Homo sapiens
CASSPRAGGDINEQFF

SEQ ID NO: 2458 - protein, 14 aa, Homo sapiens
CASSPRENTGELFF

SEQ ID NO: 2459 - protein, 12 aa, Homo sapiens
CASSPRGNEQYF

SEQ ID NO: 2460 - protein, 12 aa, Homo sapiens
CASSPRTSEWFF

SEQ ID NO: 2461 - protein, 13 aa, Homo sapiens
CASSPRTTGELFF

SEQ ID NO: 2462 - protein, 15 aa, Homo sapiens
CASSPTGGAGGELFF

SEQ ID NO: 2463 - protein, 16 aa, Homo sapiens
CASSPYPGQNYNEQFF

SEQ ID NO: 2464 - protein, 15 aa, Homo sapiens
CASSPYRSNNNEQFF

SEQ ID NO: 2465 - protein, 15 aa, Homo sapiens
CASSQGPPGANVLTF

SEQ ID NO: 2466 - protein, 14 aa, Homo sapiens
CASSRDLPSYEQYF

SEQ ID NO: 2467 - protein, 13 aa, Homo sapiens
CASSRPGTDTQYF

SEQ ID NO: 2468 - protein, 19 aa, Homo sapiens
CASSRTYTYSGTANYGYTF

SEQ ID NO: 2469 - protein, 15 aa, Homo sapiens
CASSRWDSSSYEQYF

SEQ ID NO: 2470 - protein, 15 aa, Homo sapiens
CASSSEAGAQETQYF

SEQ ID NO: 2471 - protein, 13 aa, Homo sapiens
CASSSEMNTEAFF

SEQ ID NO: 2472 - protein, 14 aa, Homo sapiens
CASSSEMNTGELFF

SEQ ID NO: 2473 - protein, 18 aa, Homo sapiens
CASSSGLAGGASSYEQYF

SEQ ID NO: 2474 - protein, 13 aa, Homo sapiens
CASSSGSYNEQFF

SEQ ID NO: 2475 - protein, 15 aa, Homo sapiens
CASSSIRLADNEQFF

SEQ ID NO: 2476 - protein, 13 aa, Homo sapiens
CASSSLLSYGYTF

SEQ ID NO: 2477 - protein, 14 aa, Homo sapiens
CASSSNWDHYGYTF

SEQ ID NO: 2478 - protein, 16 aa, Homo sapiens
CASSSSGTGYTGELFF

SEQ ID NO: 2479 - protein, 15 aa, Homo sapiens
CASSSTSGGSYEQYF

SEQ ID NO: 2480 - protein, 13 aa, Homo sapiens
CASSSYDADTQYF

SEQ ID NO: 2481 - protein, 15 aa, Homo sapiens
CASSTGTSDYNEQFF

SEQ ID NO: 2482 - protein, 16 aa, Homo sapiens
CASSWGGAGGGYEQFF

SEQ ID NO: 2483 - protein, 15 aa, Homo sapiens
CASSWGLNSGNTIYF

SEQ ID NO: 2484 - protein, 15 aa, Homo sapiens
CASSYPTGSYNEQFF

SEQ ID NO: 2485 - protein, 16 aa, Homo sapiens
CASTELTGPRANEQFF

SEQ ID NO: 2486 - protein, 14 aa, Homo sapiens
CASTLAGGVNEQFF

SEQ ID NO: 2487 - protein, 14 aa, Homo sapiens
CASSAGTANYGYTF

SEQ ID NO: 2488 - protein, 13 aa, Homo sapiens
CASSAGVSRGYTF

SEQ ID NO: 2489 - protein, 17 aa, Homo sapiens
CASSAHQGLDLGDTQYF

SEQ ID NO: 2490 - protein, 16 aa, Homo sapiens
CASSALTGNPTDTQYF

SEQ ID NO: 2491 - protein, 15 aa, Homo sapiens
CASSASGTANTEAFF

SEQ ID NO: 2492 - protein, 15 aa, Homo sapiens
CASSASQGGGTEAFF

SEQ ID NO: 2493 - protein, 15 aa, Homo sapiens
CASSATGTGGTEAFF

SEQ ID NO: 2494 - protein, 15 aa, Homo sapiens
CASSATSGDLYEQYF

SEQ ID NO: 2495 - protein, 15 aa, Homo sapiens
CASSATTGTIYEQYF

SEQ ID NO: 2496 - protein, 14 aa, Homo sapiens
CASSAYGQGTEAFF

SEQ ID NO: 2497 - protein, 16 aa, Homo sapiens
CASSAYPEGTGQDQYF

SEQ ID NO: 2498 - protein, 16 aa, Homo sapiens
CASSDGTSGRGDTQYF

SEQ ID NO: 2499 - protein, 15 aa, Homo sapiens
CASSEHGAGANVLTF

SEQ ID NO: 2500 - protein, 15 aa, Homo sapiens
CASSESGTTTDTQYF

SEQ ID NO: 2501 - protein, 15 aa, Homo sapiens
CASSEWTASTDTQYF

SEQ ID NO: 2502 - protein, 15 aa, Homo sapiens
CASSEYRGVGEKLFF

SEQ ID NO: 2503 - protein, 17 aa, Homo sapiens
CASSFGLGGPPAYEHYF

SEQ ID NO: 2504 - protein, 14 aa, Homo sapiens
CASSGDSGVTELFF

SEQ ID NO: 2505 - protein, 12 aa, Homo sapiens
CASSGDSYEQYF

SEQ ID NO: 2506 - protein, 14 aa, Homo sapiens
CASSGEDSSYEQYF

SEQ ID NO: 2507 - protein, 15 aa, Homo sapiens
CASSGGERGTYEQYF

SEQ ID NO: 2508 - protein, 17 aa, Homo sapiens
CASSGQGVISGANVLTF

SEQ ID NO: 2509 - protein, 14 aa, Homo sapiens
CASSGSSGGETQYF

SEQ ID NO: 2510 - protein, 15 aa, Homo sapiens
CASSLEGVSTDTQYF

SEQ ID NO: 2511 - protein, 15 aa, Homo sapiens
CASSLGAGQESPLHF

SEQ ID NO: 2512 - protein, 14 aa, Homo sapiens
CASSLGASTDTQYF

SEQ ID NO: 2513 - protein, 15 aa, Homo sapiens
CASSLGDGFNQPQHF

SEQ ID NO: 2514 - protein, 17 aa, Homo sapiens
CASSLGLGGSPAYYQYF

SEQ ID NO: 2515 - protein, 15 aa, Homo sapiens
CASSLGTNSNQPQHF

SEQ ID NO: 2516 - protein, 15 aa, Homo sapiens
CASSLQGGSYNEQFF

SEQ ID NO: 2517 - protein, 15 aa, Homo sapiens
CASSLRGSGVAGELF

SEQ ID NO: 2518 - protein, 14 aa, Homo sapiens
CASSPGQGSYEQYF

SEQ ID NO: 2519 - protein, 14 aa, Homo sapiens
CASSPHWSVQPQHF

SEQ ID NO: 2520 - protein, 16 aa, Homo sapiens
CASSPPAGPSYNEQFF

SEQ ID NO: 2521 - protein, 15 aa, Homo sapiens
CASSPQASSYNEQFF

SEQ ID NO: 2522 - protein, 15 aa, Homo sapiens
CASSPTDRADQPQHF

SEQ ID NO: 2523 - protein, 13 aa, Homo sapiens
CASSRGMNTEAFF

SEQ ID NO: 2524 - protein, 15 aa, Homo sapiens
CASSRWTAPQETQYF

SEQ ID NO: 2525 - protein, 16 aa, Homo sapiens
CASSSKAGGSYNEQFF

SEQ ID NO: 2526 - protein, 15 aa, Homo sapiens
CASSSRGRGQETQYF

SEQ ID NO: 2527 - protein, 14 aa, Homo sapiens
CASSSSGGGNEQFF

SEQ ID NO: 2528 - protein, 13 aa, Homo sapiens
CASSVAGSGELFF

SEQ ID NO: 2529 - protein, 14 aa, Homo sapiens
CASSVAYRGGEAFF

SEQ ID NO: 2530 - protein, 13 aa, Homo sapiens
CASSVDEGTPYTF

SEQ ID NO: 2531 - protein, 16 aa, Homo sapiens
CASSVDGGHSSYEQYF

SEQ ID NO: 2532 - protein, 15 aa, Homo sapiens
CASSVDGNSNQPQHF

SEQ ID NO: 2533 - protein, 15 aa, Homo sapiens
CASSVDLVGNNEQFF

SEQ ID NO: 2534 - protein, 15 aa, Homo sapiens
CASSVDSGEYNEQFF

SEQ ID NO: 2535 - protein, 15 aa, Homo sapiens
CASSVEASGYNEQFF

SEQ ID NO: 2536 - protein, 15 aa, Homo sapiens
CASSVEGRSTDTQYF

SEQ ID NO: 2537 - protein, 14 aa, Homo sapiens
CASSVEYRGNEQFF

SEQ ID NO: 2538 - protein, 14 aa, Homo sapiens
CASSVGAFDGEQFF

SEQ ID NO: 2539 - protein, 15 aa, Homo sapiens
CASSVGAGAKNIQYF

SEQ ID NO: 2540 - protein, 15 aa, Homo sapiens
CASSVGAGGPNEQFF

SEQ ID NO: 2541 - protein, 12 aa, Homo sapiens
CASSVGGETQYF

SEQ ID NO: 2542 - protein, 15 aa, Homo sapiens
CASSVGGGLDNEQFF

SEQ ID NO: 2543 - protein, 15 aa, Homo sapiens
CASSVGGRGTDTQYF

SEQ ID NO: 2544 - protein, 15 aa, Homo sapiens
CASSVGGSAYNEQFF

SEQ ID NO: 2545 - protein, 16 aa, Homo sapiens
CASSVGHGSGANVLTF

SEQ ID NO: 2546 - protein, 15 aa, Homo sapiens
CASSVGHLLTGELFF

SEQ ID NO: 2547 - protein, 17 aa, Homo sapiens
CASSVGLAGPPAYEQYF

SEQ ID NO: 2548 - protein, 17 aa, Homo sapiens
CASSVGLAGPPAYVQYF

SEQ ID NO: 2549 - protein, 17 aa, Homo sapiens
CASSVGLPGPPAYEQYF

SEQ ID NO: 2550 - protein, 15 aa, Homo sapiens
CASSVGNSGKETQYF

SEQ ID NO: 2551 - protein, 15 aa, Homo sapiens
CASSVGSGTGSPLHF

SEQ ID NO: 2552 - protein, 15 aa, Homo sapiens
CASSVGTGGMWEQYF

SEQ ID NO: 2553 - protein, 16 aa, Homo sapiens
CASSVGVEGVNSPLHF

SEQ ID NO: 2554 - protein, 17 aa, Homo sapiens
CASSVPRLAGGHNEQFF

SEQ ID NO: 2555 - protein, 14 aa, Homo sapiens
CASSVPYRGGEQFF

SEQ ID NO: 2556 - protein, 14 aa, Homo sapiens
CASSVQREGGEQYF

SEQ ID NO: 2557 - protein, 14 aa, Homo sapiens
CASSVRWEGYEQYF

SEQ ID NO: 2558 - protein, 14 aa, Homo sapiens
CASSVSGAYNEQFF

SEQ ID NO: 2559 - protein, 14 aa, Homo sapiens
CASSVSGDYNEQFF

SEQ ID NO: 2560 - protein, 14 aa, Homo sapiens
CASSVSGGNQPQHF

SEQ ID NO: 2561 - protein, 17 aa, Homo sapiens
CASSVSGTQPDTGELFF

SEQ ID NO: 2562 - protein, 15 aa, Homo sapiens
CASSVTGTTTDTQYF

SEQ ID NO: 2563 - protein, 15 aa, Homo sapiens
CASSVTTGGGNTIYF

SEQ ID NO: 2564 - protein, 16 aa, Homo sapiens
CASSVVPSGMYGEQFF

SEQ ID NO: 2565 - protein, 18 aa, Homo sapiens
CASSVVTSGRRSYNEQFF

SEQ ID NO: 2566 - protein, 14 aa, Homo sapiens
CASSVYDGTDTQYF

SEQ ID NO: 2567 - protein, 18 aa, Homo sapiens
CASTANSEGSYGANVLTF

SEQ ID NO: 2568 - protein, 16 aa, Homo sapiens
CAISADYSSSYNEQFF

SEQ ID NO: 2569 - protein, 14 aa, Homo sapiens
CAISESGSSYEQYF

SEQ ID NO: 2570 - protein, 15 aa, Homo sapiens
CAISESIAGVNEQFF

SEQ ID NO: 2571 - protein, 18 aa, Homo sapiens
CAISESPGGARNTDTQYF

SEQ ID NO: 2572 - protein, 16 aa, Homo sapiens
CAISGDVESSYNEQFF

SEQ ID NO: 2573 - protein, 14 aa, Homo sapiens
CAISGSRQENEQFF

SEQ ID NO: 2574 - protein, 14 aa, Homo sapiens
CAISSLAGEDTQYF

SEQ ID NO: 2575 - protein, 14 aa, Homo sapiens
CASSGGLAGYEQYF

SEQ ID NO: 2576 - protein, 13 aa, Homo sapiens
CATKDGDSYEQYF

SEQ ID NO: 2577 - protein, 14 aa, Homo sapiens
CATQGGGVNTEAFF

SEQ ID NO: 2578 - protein, 15 aa, Homo sapiens
CATVSSEGGPGELFF

SEQ ID NO: 2579 - protein, 13 aa, Homo sapiens
CASNLWPGERQYF

SEQ ID NO: 2580 - protein, 13 aa, Homo sapiens
CASRILGYNEQFF

SEQ ID NO: 2581 - protein, 12 aa, Homo sapiens
CASRPGYNEQFF

SEQ ID NO: 2582 - protein, 12 aa, Homo sapiens
CASSFERTEAFF

SEQ ID NO: 2583 - protein, 14 aa, Homo sapiens
CASSFGGVYNEQFF

SEQ ID NO: 2584 - protein, 12 aa, Homo sapiens
CASSFGQYEQYF

SEQ ID NO: 2585 - protein, 12 aa, Homo sapiens
CASSFRSNEQFF

SEQ ID NO: 2586 - protein, 16 aa, Homo sapiens
CASSGPRTGITGELFF

SEQ ID NO: 2587 - protein, 14 aa, Homo sapiens
CASSGTGANYGYTF

SEQ ID NO: 2588 - protein, 13 aa, Homo sapiens
CASSIVGGNIQYF

SEQ ID NO: 2589 - protein, 11 aa, Homo sapiens
CASSKGKTQYF

SEQ ID NO: 2590 - protein, 17 aa, Homo sapiens
CASSLAPGREHTTPLHF

SEQ ID NO: 2591 - protein, 14 aa, Homo sapiens
CASSLARENTEAFF

SEQ ID NO: 2592 - protein, 15 aa, Homo sapiens
CASSLDPQGNTEAFF

SEQ ID NO: 2593 - protein, 14 aa, Homo sapiens
CASSLDSGTDTQYF

SEQ ID NO: 2594 - protein, 13 aa, Homo sapiens
CASSLDYMQPQHF

SEQ ID NO: 2595 - protein, 15 aa, Homo sapiens
CASSLEAAVSYEQYF

SEQ ID NO: 2596 - protein, 16 aa, Homo sapiens
CASSLGARGNQETQYF

SEQ ID NO: 2597 - protein, 15 aa, Homo sapiens
CASSLGGLARYEQYF

SEQ ID NO: 2598 - protein, 14 aa, Homo sapiens
CASSLGLAADTQYF

SEQ ID NO: 2599 - protein, 13 aa, Homo sapiens
CASSLLQGGEAFF

SEQ ID NO: 2600 - protein, 15 aa, Homo sapiens
CASSLRDRNTGELFF

SEQ ID NO: 2601 - protein, 19 aa, Homo sapiens
CASSLVGTPTSGRGNEQFF

SEQ ID NO: 2602 - protein, 17 aa, Homo sapiens
CASSLVPVQGAINEQFF

SEQ ID NO: 2603 - protein, 13 aa, Homo sapiens
CASSMGVSYEQYF

SEQ ID NO: 2604 - protein, 16 aa, Homo sapiens
CASSPGTAWVQETQYF

SEQ ID NO: 2605 - protein, 15 aa, Homo sapiens
CASSRTSGSFDEQYF

SEQ ID NO: 2606 - protein, 13 aa, Homo sapiens
CASSSADSPGQYF

SEQ ID NO: 2607 - protein, 15 aa, Homo sapiens
CASSSGTSAYNEQFF

SEQ ID NO: 2608 - protein, 17 aa, Homo sapiens
CASSSPVGPRRFGEQFF

SEQ ID NO: 2609 - protein, 18 aa, Homo sapiens
CASSSPWLAGVFQETQYF

SEQ ID NO: 2610 - protein, 15 aa, Homo sapiens
CASSTAGTRVNEQFF

SEQ ID NO: 2611 - protein, 19 aa, Homo sapiens
CASSTVRHAQTANTGELFF

SEQ ID NO: 2612 - protein, 13 aa, Homo sapiens
CASSVSPTGELFF

SEQ ID NO: 2613 - protein, 14 aa, Homo sapiens
CASSWRGGTDTQYF

SEQ ID NO: 2614 - protein, 14 aa, Homo sapiens
CASSYEASQETQYF

SEQ ID NO: 2615 - protein, 13 aa, Homo sapiens
CASTVGPTGEPFF

SEQ ID NO: 2616 - protein, 16 aa, Homo sapiens
CASALGASGRTGELFF

SEQ ID NO: 2617 - protein, 13 aa, Homo sapiens
CASDRTMSTEAFF

SEQ ID NO: 2618 - protein, 13 aa, Homo sapiens
CASDSPLNTEAFF

SEQ ID NO: 2619 - protein, 13 aa, Homo sapiens
CASDSTMNTEAFF

SEQ ID NO: 2620 - protein, 16 aa, Homo sapiens
CASESSSGSDYNEQFF

SEQ ID NO: 2621 - protein, 14 aa, Homo sapiens
CASFHGVLYNEQFF

SEQ ID NO: 2622 - protein, 12 aa, Homo sapiens
CASGDSLREQFF

SEQ ID NO: 2623 - protein, 14 aa, Homo sapiens
CASGLATNPYEQYF

SEQ ID NO: 2624 - protein, 12 aa, Homo sapiens
CASGLVAGELFF

SEQ ID NO: 2625 - protein, 15 aa, Homo sapiens
CASGLVQGSYYEQYF

SEQ ID NO: 2626 - protein, 12 aa, Homo sapiens
CASGQGSYGYTF

SEQ ID NO: 2627 - protein, 12 aa, Homo sapiens
CASGRENGEQYF

SEQ ID NO: 2628 - protein, 15 aa, Homo sapiens
CASKSFFQAQETQYF

SEQ ID NO: 2629 - protein, 15 aa, Homo sapiens
CASLLFQAPPVEQYF

SEQ ID NO: 2630 - protein, 13 aa, Homo sapiens
CASNEERADTQYF

SEQ ID NO: 2631 - protein, 14 aa, Homo sapiens
CASRGQGALQPQHF

SEQ ID NO: 2632 - protein, 13 aa, Homo sapiens
CASRGTGDNEQFF

SEQ ID NO: 2633 - protein, 18 aa, Homo sapiens
CASRPKFSDPGPNNEQFF

SEQ ID NO: 2634 - protein, 16 aa, Homo sapiens
CASRSLGTPRLNEQFF

SEQ ID NO: 2635 - protein, 15 aa, Homo sapiens
CASSARTVAKNIQYF

SEQ ID NO: 2636 - protein, 13 aa, Homo sapiens
CASSFAGPTEAFF

SEQ ID NO: 2637 - protein, 13 aa, Homo sapiens
CASSFGGIDGYTF

SEQ ID NO: 2638 - protein, 15 aa, Homo sapiens
CASSFLAGAGNEQFF

SEQ ID NO: 2639 - protein, 15 aa, Homo sapiens
CASSFLPSALWDEQF

SEQ ID NO: 2640 - protein, 16 aa, Homo sapiens
CASSFRIETGRYGYTF

SEQ ID NO: 2641 - protein, 18 aa, Homo sapiens
CASSFSRGGVGRRETQDF

SEQ ID NO: 2642 - protein, 16 aa, Homo sapiens
CASSFSTCSANYGYTF

SEQ ID NO: 2643 - protein, 13 aa, Homo sapiens
CASSITGAYGYTF

SEQ ID NO: 2644 - protein, 15 aa, Homo sapiens
CASSKDRGSQETQYF

SEQ ID NO: 2645 - protein, 13 aa, Homo sapiens
CASSLAAYNEQFF

SEQ ID NO: 2646 - protein, 15 aa, Homo sapiens
CASSLEGAPGTEAFF

SEQ ID NO: 2647 - protein, 15 aa, Homo sapiens
CASSLELTGPLGYTF

SEQ ID NO: 2648 - protein, 12 aa, Homo sapiens
CASSLENQPQHF

SEQ ID NO: 2649 - protein, 15 aa, Homo sapiens
CASSLFWAPPDKQYF

SEQ ID NO: 2650 - protein, 15 aa, Homo sapiens
CASSLFWAPPVEQYF

SEQ ID NO: 2651 - protein, 15 aa, Homo sapiens
CASSLFWGPPVKQYF

SEQ ID NO: 2652 - protein, 11 aa, Homo sapiens
CASSLGETQYF

SEQ ID NO: 2653 - protein, 12 aa, Homo sapiens
CASSLGGSEAFF

SEQ ID NO: 2654 - protein, 17 aa, Homo sapiens
CASSLGSGTALGNEQFF

SEQ ID NO: 2655 - protein, 14 aa, Homo sapiens
CASSLGSLNTEAFF

SEQ ID NO: 2656 - protein, 16 aa, Homo sapiens
CASSLGTSGRWNEQFF

SEQ ID NO: 2657 - protein, 16 aa, Homo sapiens
CASSLNPSGDLYGYTF

SEQ ID NO: 2658 - protein, 14 aa, Homo sapiens
CASSLSGEFYEQYF

SEQ ID NO: 2659 - protein, 13 aa, Homo sapiens
CASSLSGGNEQYF

SEQ ID NO: 2660 - protein, 15 aa, Homo sapiens
CASSLSISGGVEQFF

SEQ ID NO: 2661 - protein, 15 aa, Homo sapiens
CASSLTGIDQETQYF

SEQ ID NO: 2662 - protein, 15 aa, Homo sapiens
CASSLTSGVGETQYF

SEQ ID NO: 2663 - protein, 14 aa, Homo sapiens
CASSLTSGYNEQFF

SEQ ID NO: 2664 - protein, 15 aa, Homo sapiens
CASSLVAGGENEQFF

SEQ ID NO: 2665 - protein, 14 aa, Homo sapiens
CASSLVGGTYEQYF

SEQ ID NO: 2666 - protein, 14 aa, Homo sapiens
CASSLYSGRHEQFF

SEQ ID NO: 2667 - protein, 11 aa, Homo sapiens
CASSPAGELFF

SEQ ID NO: 2668 - protein, 16 aa, Homo sapiens
CASSPITRAPDNEQFF

SEQ ID NO: 2669 - protein, 15 aa, Homo sapiens
CASSPRDRVFYEQYF

SEQ ID NO: 2670 - protein, 17 aa, Homo sapiens
CASSPRTSGRGTDTQYF

SEQ ID NO: 2671 - protein, 14 aa, Homo sapiens
CASSPSGDYNEQFF

SEQ ID NO: 2672 - protein, 13 aa, Homo sapiens
CASSPTGAGELFF

SEQ ID NO: 2673 - protein, 13 aa, Homo sapiens
CASSRTGSDTQYF

SEQ ID NO: 2674 - protein, 14 aa, Homo sapiens
CASSSGGGSYEQYF

SEQ ID NO: 2675 - protein, 14 aa, Homo sapiens
CASSSGQGNQPQHF

SEQ ID NO: 2676 - protein, 14 aa, Homo sapiens
CASSSIDGFYEQYF

SEQ ID NO: 2677 - protein, 18 aa, Homo sapiens
CASSSPIYRGQLNYGYTF

SEQ ID NO: 2678 - protein, 14 aa, Homo sapiens
CASSTGTPLYEQYF

SEQ ID NO: 2679 - protein, 17 aa, Homo sapiens
CASSTLAGGSHTGELFF

SEQ ID NO: 2680 - protein, 13 aa, Homo sapiens
CASSVASYNEQFF

SEQ ID NO: 2681 - protein, 16 aa, Homo sapiens
CASSWDLTGEGRVAFF

SEQ ID NO: 2682 - protein, 17 aa, Homo sapiens
CASSWTSGSSGYNEQFF

SEQ ID NO: 2683 - protein, 15 aa, Homo sapiens
CASTSSGRDRDTQYF

SEQ ID NO: 2684 - protein, 15 aa, Homo sapiens
CATLCTHGVGETQYF

SEQ ID NO: 2685 - protein, 19 aa, Homo sapiens
CGMSSGEWKRGGRGDTSYF

SEQ ID NO: 2686 - protein, 16 aa, Homo sapiens
CASRLTGTYYNSPLHF

SEQ ID NO: 2687 - protein, 16 aa, Homo sapiens
CASSFGGEGSYNEQFF

SEQ ID NO: 2688 - protein, 15 aa, Homo sapiens
CASSFRAGLLGELFF

SEQ ID NO: 2689 - protein, 17 aa, Homo sapiens
CASSFSGSQFIRKTQYF

SEQ ID NO: 2690 - protein, 16 aa, Homo sapiens
CASSHGLAGLTGELFF

SEQ ID NO: 2691 - protein, 14 aa, Homo sapiens
CASSIQRDQETQYF

SEQ ID NO: 2692 - protein, 14 aa, Homo sapiens
CASSLAASGPAQFF

SEQ ID NO: 2693 - protein, 15 aa, Homo sapiens
CASSLARGRIHEQYF

SEQ ID NO: 2694 - protein, 13 aa, Homo sapiens
CASSLEGLDEQYF

SEQ ID NO: 2695 - protein, 12 aa, Homo sapiens
CASSLGGDEQFF

SEQ ID NO: 2696 - protein, 18 aa, Homo sapiens
CASSLGRTSGPPRDEQFF

SEQ ID NO: 2697 - protein, 16 aa, Homo sapiens
CASSLGVGVDGETQYF

SEQ ID NO: 2698 - protein, 15 aa, Homo sapiens
CASSLGYGSTYEQYF

SEQ ID NO: 2699 - protein, 11 aa, Homo sapiens
CASSLRGEQYF

SEQ ID NO: 2700 - protein, 11 aa, Homo sapiens
CASSLVLTPFF

SEQ ID NO: 2701 - protein, 14 aa, Homo sapiens
CASSLVTPGNTIYF

SEQ ID NO: 2702 - protein, 14 aa, Homo sapiens
CASSLWRNSYEQYF

SEQ ID NO: 2703 - protein, 15 aa, Homo sapiens
CASSNPGQGDSPLHF

SEQ ID NO: 2704 - protein, 14 aa, Homo sapiens
CASSPRDSQETQYF

SEQ ID NO: 2705 - protein, 12 aa, Homo sapiens
CASSQWTGELFF

SEQ ID NO: 2706 - protein, 12 aa, Homo sapiens
CASSRGFDTIYF

SEQ ID NO: 2707 - protein, 18 aa, Homo sapiens
CASSSDNPLAGETDTQYF

SEQ ID NO: 2708 - protein, 17 aa, Homo sapiens
CASSSDRTSHRTDTQYF

SEQ ID NO: 2709 - protein, 13 aa, Homo sapiens
CASSSGEGQPQHF

SEQ ID NO: 2710 - protein, 15 aa, Homo sapiens
CASSSPFEGRDTQYF

SEQ ID NO: 2711 - protein, 15 aa, Homo sapiens
CASSSRDRGTYEQYF

SEQ ID NO: 2712 - protein, 15 aa, Homo sapiens
CASSSRGARTDTQYF

SEQ ID NO: 2713 - protein, 13 aa, Homo sapiens
CAPSHSPGGTHYF

SEQ ID NO: 2714 - protein, 14 aa, Homo sapiens
CASREPGTGKEQYF

SEQ ID NO: 2715 - protein, 14 aa, Homo sapiens
CASRISGGLNEQFF

SEQ ID NO: 2716 - protein, 18 aa, Homo sapiens
CASSHDRDYLSGTDTQYF

SEQ ID NO: 2717 - protein, 15 aa, Homo sapiens
CASSLLAGSYNEQFF

SEQ ID NO: 2718 - protein, 17 aa, Homo sapiens
CASSQDPFRGGSYEQYF

SEQ ID NO: 2719 - protein, 12 aa, Homo sapiens
CASSQDRVAQFF

SEQ ID NO: 2720 - protein, 17 aa, Homo sapiens
CASSQDYTTSRHNEQFF

SEQ ID NO: 2721 - protein, 19 aa, Homo sapiens
CASSQEGERTRRGTGELFF

SEQ ID NO: 2722 - protein, 18 aa, Homo sapiens
CASSQETLAGWYQETQYF

SEQ ID NO: 2723 - protein, 14 aa, Homo sapiens
CASSQEWGQETQYF

SEQ ID NO: 2724 - protein, 13 aa, Homo sapiens
CASSQGARTEAFF

SEQ ID NO: 2725 - protein, 19 aa, Homo sapiens
CASSQGASGRAKGTDTQYF

SEQ ID NO: 2726 - protein, 17 aa, Homo sapiens
CASSQGLAGVTSYEQYF

SEQ ID NO: 2727 - protein, 13 aa, Homo sapiens
CASSQGRGKEQYF

SEQ ID NO: 2728 - protein, 18 aa, Homo sapiens
CASSQPTRQGPNTGELFF

SEQ ID NO: 2729 - protein, 13 aa, Homo sapiens
CASSQSPGGTQYF

SEQ ID NO: 2730 - protein, 14 aa, Homo sapiens
CASSTSGHQETQYF

SEQ ID NO: 2731 - protein, 12 aa, Homo sapiens
CAIQGTSETQYF

SEQ ID NO: 2732 - protein, 14 aa, Homo sapiens
CATGPERVVDEQFF

SEQ ID NO: 2733 - protein, 17 aa, Homo sapiens
CATRKPNEPSSYNEQFF

SEQ ID NO: 2734 - protein, 14 aa, Homo sapiens
CATRLKGGYNEQFF

SEQ ID NO: 2735 - protein, 13 aa, Homo sapiens
CATSAHGGETQYF

SEQ ID NO: 2736 - protein, 17 aa, Homo sapiens
CATSDEGQGARTGELFF

SEQ ID NO: 2737 - protein, 13 aa, Homo sapiens
CATSGLAGEEQFF

SEQ ID NO: 2738 - protein, 16 aa, Homo sapiens
CATSIAGTMNTGEQFF

SEQ ID NO: 2739 - protein, 13 aa, Homo sapiens
CATSIVAGENNFF

SEQ ID NO: 2740 - protein, 16 aa, Homo sapiens
CATSKDYTGSYNEQFF

SEQ ID NO: 2741 - protein, 14 aa, Homo sapiens
CATSLTSGYNEQFF

SEQ ID NO: 2742 - protein, 13 aa, Homo sapiens
CATSNHGGETQYF

SEQ ID NO: 2743 - protein, 14 aa, Homo sapiens
CATSPGGSLSEQYF

SEQ ID NO: 2744 - protein, 15 aa, Homo sapiens
CATSPRDTVQETQYF

SEQ ID NO: 2745 - protein, 13 aa, Homo sapiens
CATSRAAGYEQYF

SEQ ID NO: 2746 - protein, 14 aa, Homo sapiens
CATSRAGANQPQHF

SEQ ID NO: 2747 - protein, 15 aa, Homo sapiens
CATSRARTGLNEQFF

SEQ ID NO: 2748 - protein, 14 aa, Homo sapiens
CATSRDAGQYEQYF

SEQ ID NO: 2749 - protein, 16 aa, Homo sapiens
CATSRDGTSGRYEQYF

SEQ ID NO: 2750 - protein, 16 aa, Homo sapiens
CATSRDHAASSWPQHF

SEQ ID NO: 2751 - protein, 16 aa, Homo sapiens
CATSRDPSGRADTQYF

SEQ ID NO: 2752 - protein, 16 aa, Homo sapiens
CATSRDPSRRIETQYF

SEQ ID NO: 2753 - protein, 14 aa, Homo sapiens
CATSRDRGDNEQFF

SEQ ID NO: 2754 - protein, 16 aa, Homo sapiens
CATSREQGSGANVLTF

SEQ ID NO: 2755 - protein, 17 aa, Homo sapiens
CATSRETGTGGSDTQYF

SEQ ID NO: 2756 - protein, 16 aa, Homo sapiens
CATSREVGVGSTEAFF

SEQ ID NO: 2757 - protein, 17 aa, Homo sapiens
CATSRGELLAGASEQYF

SEQ ID NO: 2758 - protein, 15 aa, Homo sapiens
CATSRGKGGEETQYF

SEQ ID NO: 2759 - protein, 14 aa, Homo sapiens
CATSRGQGAREQYF

SEQ ID NO: 2760 - protein, 16 aa, Homo sapiens
CATSRGQLSSYNEQFF

SEQ ID NO: 2761 - protein, 15 aa, Homo sapiens
CATSRGRGESQPQHF

SEQ ID NO: 2762 - protein, 17 aa, Homo sapiens
CATSRGTGRRGTDTQYF

SEQ ID NO: 2763 - protein, 14 aa, Homo sapiens
CATSRGTSANEQFF

SEQ ID NO: 2764 - protein, 16 aa, Homo sapiens
CATSRRLADSSYEQYF

SEQ ID NO: 2765 - protein, 14 aa, Homo sapiens
CATSRRTAPYEQYF

SEQ ID NO: 2766 - protein, 15 aa, Homo sapiens
CATSRSSGQWYEQYF

SEQ ID NO: 2767 - protein, 13 aa, Homo sapiens
CATSRVSGDEAFF

SEQ ID NO: 2768 - protein, 13 aa, Homo sapiens
CATSRWGGETQYF

SEQ ID NO: 2769 - protein, 15 aa, Homo sapiens
CATSRYRESNSPLHF

SEQ ID NO: 2770 - protein, 15 aa, Homo sapiens
CATSSAATSTDTQYF

SEQ ID NO: 2771 - protein, 14 aa, Homo sapiens
CATSSFGTQYEQYF

SEQ ID NO: 2772 - protein, 13 aa, Homo sapiens
CATSSHGGETQYF

SEQ ID NO: 2773 - protein, 13 aa, Homo sapiens
CATSSTAGETQYF

SEQ ID NO: 2774 - protein, 13 aa, Homo sapiens
CATSTVAGETQYF

SEQ ID NO: 2775 - protein, 14 aa, Homo sapiens
CASSPEVSQETQYF

SEQ ID NO: 2776 - protein, 14 aa, Homo sapiens
CASSPGAGNTEAFF

SEQ ID NO: 2777 - protein, 17 aa, Homo sapiens
CASSPGQSGEFGNTIYF

SEQ ID NO: 2778 - protein, 13 aa, Homo sapiens
CASSPGSGQPQHF

SEQ ID NO: 2779 - protein, 16 aa, Homo sapiens
CASSPPDRRTGNTIYF

SEQ ID NO: 2780 - protein, 16 aa, Homo sapiens
CASSPPVAALESPLHF

SEQ ID NO: 2781 - protein, 14 aa, Homo sapiens
CASSPRDGANEQFF

SEQ ID NO: 2782 - protein, 17 aa, Homo sapiens
CASSPVQGASGANVLTF

SEQ ID NO: 2783 - protein, 15 aa, Homo sapiens
CASSQGQGSTGELFF

SEQ ID NO: 2784 - protein, 16 aa, Homo sapiens
CASSRTGPESPYEQYF

SEQ ID NO: 2785 - protein, 14 aa, Homo sapiens
CASSRTTNTGELFF

SEQ ID NO: 2786 - protein, 16 aa, Homo sapiens
CASAGGRLAVRDTQYF

SEQ ID NO: 2787 - protein, 12 aa, Homo sapiens
CASEDQVDTQYF

SEQ ID NO: 2788 - protein, 14 aa, Homo sapiens
CASGQKTSGNTIYF

SEQ ID NO: 2789 - protein, 10 aa, Homo sapiens
CASGSGGYTF

SEQ ID NO: 2790 - protein, 12 aa, Homo sapiens
CASGTGPYEQYF

SEQ ID NO: 2791 - protein, 13 aa, Homo sapiens
CASHGRVGTEAFF

SEQ ID NO: 2792 - protein, 15 aa, Homo sapiens
CASIQGAGSNQPQHF

SEQ ID NO: 2793 - protein, 13 aa, Homo sapiens
CASLAGGLNEQFF

SEQ ID NO: 2794 - protein, 16 aa, Homo sapiens
CASMIPSTGGRAEAFF

SEQ ID NO: 2795 - protein, 15 aa, Homo sapiens
CASQGLAGSYNEQFF

SEQ ID NO: 2796 - protein, 12 aa, Homo sapiens
CASRGDSYEQYF

SEQ ID NO: 2797 - protein, 13 aa, Homo sapiens
CASRHWLTGELFF

SEQ ID NO: 2798 - protein, 13 aa, Homo sapiens
CASRSGPTGELFF

SEQ ID NO: 2799 - protein, 15 aa, Homo sapiens
CASRSSGGNLYEQYF

SEQ ID NO: 2800 - protein, 14 aa, Homo sapiens
CASRVAAYNQPQHF

SEQ ID NO: 2801 - protein, 15 aa, Homo sapiens
CASRVAGGPYNEQFF

SEQ ID NO: 2802 - protein, 13 aa, Homo sapiens
CASSAGTAYGYTF

SEQ ID NO: 2803 - protein, 14 aa, Homo sapiens
CASSALLAPGELFF

SEQ ID NO: 2804 - protein, 17 aa, Homo sapiens
CASSATSGSGNYNEQFF

SEQ ID NO: 2805 - protein, 17 aa, Homo sapiens
CASSFTSGSIWAGELFF

SEQ ID NO: 2806 - protein, 17 aa, Homo sapiens
CASSGLAGSSRADTQYF

SEQ ID NO: 2807 - protein, 17 aa, Homo sapiens
CASSGLSGSSRADTHYF

SEQ ID NO: 2808 - protein, 16 aa, Homo sapiens
CASSGRQGKNTGELFF

SEQ ID NO: 2809 - protein, 12 aa, Homo sapiens
CASSIADREAFF

SEQ ID NO: 2810 - protein, 13 aa, Homo sapiens
CASSIAGYNEQFF

SEQ ID NO: 2811 - protein, 14 aa, Homo sapiens
CASSIAVGLNEQFF

SEQ ID NO: 2812 - protein, 16 aa, Homo sapiens
CASSIDGGAGVYEQYF

SEQ ID NO: 2813 - protein, 13 aa, Homo sapiens
CASSIDKPNEQFF

SEQ ID NO: 2814 - protein, 15 aa, Homo sapiens
CASSIDSDLNQPQHF

SEQ ID NO: 2815 - protein, 17 aa, Homo sapiens
CASSIDTSGGSYNEQFF

SEQ ID NO: 2816 - protein, 16 aa, Homo sapiens
CASSIDWTGYLETQYF

SEQ ID NO: 2817 - protein, 14 aa, Homo sapiens
CASSIFFGSYEQYF

SEQ ID NO: 2818 - protein, 11 aa, Homo sapiens
CASSIFGEQHF

SEQ ID NO: 2819 - protein, 16 aa, Homo sapiens
CASSIFGTSYTGELFF

SEQ ID NO: 2820 - protein, 15 aa, Homo sapiens
CASSIGASGSLEQFF

SEQ ID NO: 2821 - protein, 16 aa, Homo sapiens
CASSIGGLAGADTQYF

SEQ ID NO: 2822 - protein, 16 aa, Homo sapiens
CASSIGGTYGNQPQHF

SEQ ID NO: 2823 - protein, 18 aa, Homo sapiens
CASSIGHTGGLAKNIQYF

SEQ ID NO: 2824 - protein, 15 aa, Homo sapiens
CASSIGQVSYNEQFF

SEQ ID NO: 2825 - protein, 16 aa, Homo sapiens
CASSIGSGGYFYGYTF

SEQ ID NO: 2826 - protein, 14 aa, Homo sapiens
CASSIGTGSYEQYF

SEQ ID NO: 2827 - protein, 11 aa, Homo sapiens
CASSIGYGYTF

SEQ ID NO: 2828 - protein, 17 aa, Homo sapiens
CASSIISGRDAYNEQFF

SEQ ID NO: 2829 - protein, 17 aa, Homo sapiens
CASSIKQGAGMNTEAFF

SEQ ID NO: 2830 - protein, 12 aa, Homo sapiens
CASSILFNEQFF

SEQ ID NO: 2831 - protein, 15 aa, Homo sapiens
CASSILLAAYNEQFF

SEQ ID NO: 2832 - protein, 14 aa, Homo sapiens
CASSILLGHNEQFF

SEQ ID NO: 2833 - protein, 13 aa, Homo sapiens
CASSINSNQPQHF

SEQ ID NO: 2834 - protein, 14 aa, Homo sapiens
CASSIRDSQETQYF

SEQ ID NO: 2835 - protein, 16 aa, Homo sapiens
CASSISGTGSNQPQHF

SEQ ID NO: 2836 - protein, 15 aa, Homo sapiens
CASSISRDRAREQYF

SEQ ID NO: 2837 - protein, 15 aa, Homo sapiens
CASSITSGEPYEQYF

SEQ ID NO: 2838 - protein, 13 aa, Homo sapiens
CASSIVLNQPQHF

SEQ ID NO: 2839 - protein, 15 aa, Homo sapiens
CASSIVVDSYYEQYF

SEQ ID NO: 2840 - protein, 15 aa, Homo sapiens
CASSIWGGGTHPQVF

SEQ ID NO: 2841 - protein, 13 aa, Homo sapiens
CASSIWPADEQYF

SEQ ID NO: 2842 - protein, 13 aa, Homo sapiens
CASSLASGGELFF

SEQ ID NO: 2843 - protein, 14 aa, Homo sapiens
CASSLLGGSYEQYF

SEQ ID NO: 2844 - protein, 14 aa, Homo sapiens
CASSLRSREYEQYF

SEQ ID NO: 2845 - protein, 13 aa, Homo sapiens
CASSMDPGQPQHF

SEQ ID NO: 2846 - protein, 13 aa, Homo sapiens
CASSMGMGEPQHF

SEQ ID NO: 2847 - protein, 14 aa, Homo sapiens
CASSMLPGTDTQYF

SEQ ID NO: 2848 - protein, 17 aa, Homo sapiens
CASSMTSGGSSYNEQFF

SEQ ID NO: 2849 - protein, 18 aa, Homo sapiens
CASSMVRLRGTLNNEQFF

SEQ ID NO: 2850 - protein, 11 aa, Homo sapiens
CASSMYNEQFF

SEQ ID NO: 2851 - protein, 16 aa, Homo sapiens
CASSNALAGPYNEQFF

SEQ ID NO: 2852 - protein, 14 aa, Homo sapiens
CASSNGAIWNEQFF

SEQ ID NO: 2853 - protein, 16 aa, Homo sapiens
CASSPAPGQGKDGYTF

SEQ ID NO: 2854 - protein, 14 aa, Homo sapiens
CASSPGLKTGEQFF

SEQ ID NO: 2855 - protein, 16 aa, Homo sapiens
CASSPIGTGEVQPQHF

SEQ ID NO: 2856 - protein, 15 aa, Homo sapiens
CASSPPGGGQDTQYF

SEQ ID NO: 2857 - protein, 16 aa, Homo sapiens
CASSPTDTSSYNEQFF

SEQ ID NO: 2858 - protein, 15 aa, Homo sapiens
CASSPYRQGEDIQYF

SEQ ID NO: 2859 - protein, 15 aa, Homo sapiens
CASSQGFTSNQPQHF

SEQ ID NO: 2860 - protein, 14 aa, Homo sapiens
CASSQQGGNSPLHF

SEQ ID NO: 2861 - protein, 14 aa, Homo sapiens
CASSQTATNEKLFF

SEQ ID NO: 2862 - protein, 13 aa, Homo sapiens
CASSQTGADTQYF

SEQ ID NO: 2863 - protein, 13 aa, Homo sapiens
CASSQTGGYEQYF

SEQ ID NO: 2864 - protein, 15 aa, Homo sapiens
CASSRDPSGIDTQYF

SEQ ID NO: 2865 - protein, 13 aa, Homo sapiens
CASSRGFSNEQYF

SEQ ID NO: 2866 - protein, 15 aa, Homo sapiens
CASSRLAIGTDTQYF

SEQ ID NO: 2867 - protein, 16 aa, Homo sapiens
CASSSAEEGVGEKLFF

SEQ ID NO: 2868 - protein, 15 aa, Homo sapiens
CASSSAGGWSTEAFF

SEQ ID NO: 2869 - protein, 22 aa, Homo sapiens
CASSSEVWGDRGLAGPYNEQFF

SEQ ID NO: 2870 - protein, 15 aa, Homo sapiens
CASSSRQVSYNEQFF

SEQ ID NO: 2871 - protein, 16 aa, Homo sapiens
CASSSSWDRVYNEQFF

SEQ ID NO: 2872 - protein, 11 aa, Homo sapiens
CASSTAGELFF

SEQ ID NO: 2873 - protein, 13 aa, Homo sapiens
CASSTAVAYEQYF

SEQ ID NO: 2874 - protein, 17 aa, Homo sapiens
CASSTGLAGVRAGELFF

SEQ ID NO: 2875 - protein, 19 aa, Homo sapiens
CASSTHEGLAGGQGDEQFF

SEQ ID NO: 2876 - protein, 16 aa, Homo sapiens
CASSTNADDLTGELFF

SEQ ID NO: 2877 - protein, 14 aa, Homo sapiens
CASSVGQGRTEAFF

SEQ ID NO: 2878 - protein, 15 aa, Homo sapiens
CASSVRDGGTYEQYF

SEQ ID NO: 2879 - protein, 14 aa, Homo sapiens
CASTNGINTGELFF

SEQ ID NO: 2880 - protein, 17 aa, Homo sapiens
CASTPGEGTSRTGELFF

SEQ ID NO: 2881 - protein, 11 aa, Homo sapiens
CASVQGGEQCF

SEQ ID NO: 2882 - protein, 11 aa, Homo sapiens
CASVQGGEQYF

SEQ ID NO: 2883 - protein, 16 aa, Homo sapiens
CASYGPWRASYNEQFF

SEQ ID NO: 2884 - protein, 10 aa, Homo sapiens
CATKAGELFF

SEQ ID NO: 2885 - protein, 14 aa, Homo sapiens
CASSKSRENSPLHF

SEQ ID NO: 2886 - protein, 18 aa, Homo sapiens
CSAARDKLPLLWGYEQYF

SEQ ID NO: 2887 - protein, 15 aa, Homo sapiens
CSADAGGANTGELFF

SEQ ID NO: 2888 - protein, 13 aa, Homo sapiens
CSADKTSYNEQFF

SEQ ID NO: 2889 - protein, 11 aa, Homo sapiens
CSADREPEAFF

SEQ ID NO: 2890 - protein, 15 aa, Homo sapiens
CSADTGGANTGELFF

SEQ ID NO: 2891 - protein, 15 aa, Homo sapiens
CSADTSVPSYNEQFF

SEQ ID NO: 2892 - protein, 13 aa, Homo sapiens
CSAETGTSIEQYF

SEQ ID NO: 2893 - protein, 15 aa, Homo sapiens
CSAFPPGGPSDTQYF

SEQ ID NO: 2894 - protein, 14 aa, Homo sapiens
CSAGAGAGQETQYF

SEQ ID NO: 2895 - protein, 17 aa, Homo sapiens
CSAGGWDRGLKGTEAFF

SEQ ID NO: 2896 - protein, 18 aa, Homo sapiens
CSAGIIVRLAASTDTQYF

SEQ ID NO: 2897 - protein, 13 aa, Homo sapiens
CSAGQGGKETQYF

SEQ ID NO: 2898 - protein, 15 aa, Homo sapiens
CSAHAAGGEGQPQHF

SEQ ID NO: 2899 - protein, 16 aa, Homo sapiens
CSAIASGRAGPDTQYF

SEQ ID NO: 2900 - protein, 14 aa, Homo sapiens
CSAIEGSGWNEQYF

SEQ ID NO: 2901 - protein, 14 aa, Homo sapiens
CSAIRAGGHETQYF

SEQ ID NO: 2902 - protein, 15 aa, Homo sapiens
CSAIRTSGVGDTQYF

SEQ ID NO: 2903 - protein, 17 aa, Homo sapiens
CSAITPGHRSGANVLTF

SEQ ID NO: 2904 - protein, 14 aa, Homo sapiens
CSALGDRTGYEQYF

SEQ ID NO: 2905 - protein, 15 aa, Homo sapiens
CSALGELAGVGEQFF

SEQ ID NO: 2906 - protein, 14 aa, Homo sapiens
CSALSGTPHNEQFF

SEQ ID NO: 2907 - protein, 10 aa, Homo sapiens
CSALVGIHTF

SEQ ID NO: 2908 - protein, 12 aa, Homo sapiens
CSANPQGYGYTF

SEQ ID NO: 2909 - protein, 15 aa, Homo sapiens
CSANSGLAGTNEQFF

SEQ ID NO: 2910 - protein, 14 aa, Homo sapiens
CSANSMSGSETQYF

SEQ ID NO: 2911 - protein, 19 aa, Homo sapiens
CSAPASLASQRGSYNEQFF

SEQ ID NO: 2912 - protein, 15 aa, Homo sapiens
CSAPGGTDLNQPQHF

SEQ ID NO: 2913 - protein, 15 aa, Homo sapiens
CSAPLIREGPGELFF

SEQ ID NO: 2914 - protein, 15 aa, Homo sapiens
CSAPNLNRGDYEQYF

SEQ ID NO: 2915 - protein, 19 aa, Homo sapiens
CSAPNTGGQGRWSNQPQHF

SEQ ID NO: 2916 - protein, 13 aa, Homo sapiens
CSAPTGDASEKYF

SEQ ID NO: 2917 - protein, 15 aa, Homo sapiens
CSAPWASGSRGTQYF

SEQ ID NO: 2918 - protein, 15 aa, Homo sapiens
CSARAHGHSNEKLFF

SEQ ID NO: 2919 - protein, 14 aa, Homo sapiens
CSARALAGEYEQYF

SEQ ID NO: 2920 - protein, 14 aa, Homo sapiens
CSARALGGGQPQHF

SEQ ID NO: 2921 - protein, 15 aa, Homo sapiens
CSARDDGTSHNEQFF

SEQ ID NO: 2922 - protein, 15 aa, Homo sapiens
CSARDDKGPGDEQFF

SEQ ID NO: 2923 - protein, 15 aa, Homo sapiens
CSARDEGLLSYEQYF

SEQ ID NO: 2924 - protein, 15 aa, Homo sapiens
CSARDEGRDYNEQFF

SEQ ID NO: 2925 - protein, 18 aa, Homo sapiens
CSARDFGGRRASYNEQFF

SEQ ID NO: 2926 - protein, 14 aa, Homo sapiens
CSARDFTSSNEQFF

SEQ ID NO: 2927 - protein, 13 aa, Homo sapiens
CSARDGIYNEQFF

SEQ ID NO: 2928 - protein, 13 aa, Homo sapiens
CSARDGNTGELFF

SEQ ID NO: 2929 - protein, 16 aa, Homo sapiens
CSARDGSGMNTGELFF

SEQ ID NO: 2930 - protein, 13 aa, Homo sapiens
CSARDGTGNGYTF

SEQ ID NO: 2931 - protein, 16 aa, Homo sapiens
CSARDGTHYSNQPQHF

SEQ ID NO: 2932 - protein, 16 aa, Homo sapiens
CSARDHLAGAFNEQFF

SEQ ID NO: 2933 - protein, 15 aa, Homo sapiens
CSARDLGGFKDTQYF

SEQ ID NO: 2934 - protein, 13 aa, Homo sapiens
CSARDLGTGELFF

SEQ ID NO: 2935 - protein, 14 aa, Homo sapiens
CSARDLGTNEKLFF

SEQ ID NO: 2936 - protein, 15 aa, Homo sapiens
CSARDNIATNEKLFF

SEQ ID NO: 2937 - protein, 15 aa, Homo sapiens
CSARDPAANTGELFF

SEQ ID NO: 2938 - protein, 14 aa, Homo sapiens
CSARDPDRLYEQYF

SEQ ID NO: 2939 - protein, 18 aa, Homo sapiens
CSARDPGLAGREWVRQFF

SEQ ID NO: 2940 - protein, 19 aa, Homo sapiens
CSARDPTATGLADYNEQFF

SEQ ID NO: 2941 - protein, 17 aa, Homo sapiens
CSARDPYALAGIYEQYF

SEQ ID NO: 2942 - protein, 15 aa, Homo sapiens
CSARDQTGIFGEQYF

SEQ ID NO: 2943 - protein, 16 aa, Homo sapiens
CSARDREGGEVDTQYF

SEQ ID NO: 2944 - protein, 14 aa, Homo sapiens
CSARDRPHSYEQYF

SEQ ID NO: 2945 - protein, 14 aa, Homo sapiens
CSARDRRGHYGYTF

SEQ ID NO: 2946 - protein, 15 aa, Homo sapiens
CSARDRRRINQPQHF

SEQ ID NO: 2947 - protein, 13 aa, Homo sapiens
CSARDRSSYEQYF

SEQ ID NO: 2948 - protein, 14 aa, Homo sapiens
CSARDSGAAYEQYF

SEQ ID NO: 2949 - protein, 15 aa, Homo sapiens
CSARDTPSGNQPQHF

SEQ ID NO: 2950 - protein, 16 aa, Homo sapiens
CSARDVLAGKMETQYF

SEQ ID NO: 2951 - protein, 14 aa, Homo sapiens
CSARDWDSSYEQYF

SEQ ID NO: 2952 - protein, 15 aa, Homo sapiens
CSAREGDRDTDTQYF

SEQ ID NO: 2953 - protein, 13 aa, Homo sapiens
CSARETGYYEQYF

SEQ ID NO: 2954 - protein, 18 aa, Homo sapiens
CSARFSGRATQMQETQYF

SEQ ID NO: 2955 - protein, 15 aa, Homo sapiens
CSARGAAWYQETQYF

SEQ ID NO: 2956 - protein, 14 aa, Homo sapiens
CSARGAGVPNEQFF

SEQ ID NO: 2957 - protein, 13 aa, Homo sapiens
CSARGGGNSPLHF

SEQ ID NO: 2958 - protein, 16 aa, Homo sapiens
CSARGGVSGRTDTQYF

SEQ ID NO: 2959 - protein, 13 aa, Homo sapiens
CSARGKRDYEQYF

SEQ ID NO: 2960 - protein, 15 aa, Homo sapiens
CSARGLRDDSYEQYF

SEQ ID NO: 2961 - protein, 15 aa, Homo sapiens
CSARGMDYLSYEQYF

SEQ ID NO: 2962 - protein, 14 aa, Homo sapiens
CSARGPSVSYEQYF

SEQ ID NO: 2963 - protein, 15 aa, Homo sapiens
CSARGQWASSYEQYF

SEQ ID NO: 2964 - protein, 13 aa, Homo sapiens
CSARGTAEYEQYF

SEQ ID NO: 2965 - protein, 14 aa, Homo sapiens
CSARHTSFQETQYF

SEQ ID NO: 2966 - protein, 14 aa, Homo sapiens
CSARIAGVAYEQYF

SEQ ID NO: 2967 - protein, 13 aa, Homo sapiens
CSARILLEGEAFF

SEQ ID NO: 2968 - protein, 14 aa, Homo sapiens
CSARKLGIEDTQYF

SEQ ID NO: 2969 - protein, 14 aa, Homo sapiens
CSARLAGDTGELFF

SEQ ID NO: 2970 - protein, 14 aa, Homo sapiens
CSARLERGDNEQFF

SEQ ID NO: 2971 - protein, 13 aa, Homo sapiens
CSARLRDTYEQYF

SEQ ID NO: 2972 - protein, 16 aa, Homo sapiens
CSARMGLAGDTGELFF

SEQ ID NO: 2973 - protein, 15 aa, Homo sapiens
CSARNGEPGPNEQFF

SEQ ID NO: 2974 - protein, 15 aa, Homo sapiens
CSARNRDGAYNEQFF

SEQ ID NO: 2975 - protein, 12 aa, Homo sapiens
CSARPGGYEQYF

SEQ ID NO: 2976 - protein, 14 aa, Homo sapiens
CSARQGLGNQPQHF

SEQ ID NO: 2977 - protein, 13 aa, Homo sapiens
CSARRAGADTQYF

SEQ ID NO: 2978 - protein, 14 aa, Homo sapiens
CSARRQGSAYEQYF

SEQ ID NO: 2979 - protein, 12 aa, Homo sapiens
CSARSRTYEQYF

SEQ ID NO: 2980 - protein, 14 aa, Homo sapiens
CSARTRLILEPQHF

SEQ ID NO: 2981 - protein, 13 aa, Homo sapiens
CSARTSGDNEQFF

SEQ ID NO: 2982 - protein, 16 aa, Homo sapiens
CSARTSGRGLGGEQYF

SEQ ID NO: 2983 - protein, 16 aa, Homo sapiens
CSARTSGRLNPDEQFF

SEQ ID NO: 2984 - protein, 16 aa, Homo sapiens
CSARVAGAGESDTQYF

SEQ ID NO: 2985 - protein, 12 aa, Homo sapiens
CSARVLDYEQYF

SEQ ID NO: 2986 - protein, 14 aa, Homo sapiens
CSARVPGQNYEQYF

SEQ ID NO: 2987 - protein, 18 aa, Homo sapiens
CSARVPPETGTYTYEQYF

SEQ ID NO: 2988 - protein, 13 aa, Homo sapiens
CSARVREAETQYF

SEQ ID NO: 2989 - protein, 15 aa, Homo sapiens
CSARVREGLSNEQFF

SEQ ID NO: 2990 - protein, 15 aa, Homo sapiens
CSASADRGSGREQYF

SEQ ID NO: 2991 - protein, 11 aa, Homo sapiens
CSASAGGEQFF

SEQ ID NO: 2992 - protein, 15 aa, Homo sapiens
CSASAGGTGHHPQHF

SEQ ID NO: 2993 - protein, 15 aa, Homo sapiens
CSASAGGTGHQPQFF

SEQ ID NO: 2994 - protein, 15 aa, Homo sapiens
CSASAGGTGHQPQHF

SEQ ID NO: 2995 - protein, 15 aa, Homo sapiens
CSASARDGFTYEQYF

SEQ ID NO: 2996 - protein, 16 aa, Homo sapiens
CSASDLAGETTDTQYF

SEQ ID NO: 2997 - protein, 15 aa, Homo sapiens
CSASGAGISSYEQYF

SEQ ID NO: 2998 - protein, 16 aa, Homo sapiens
CSASGGAGSSKNIQYF

SEQ ID NO: 2999 - protein, 18 aa, Homo sapiens
CSASGGLAGGSTYNEQFF

SEQ ID NO: 3000 - protein, 14 aa, Homo sapiens
CSASGLADSYEQYF

SEQ ID NO: 3001 - protein, 12 aa, Homo sapiens
CSASGSQETQYF

SEQ ID NO: 3002 - protein, 13 aa, Homo sapiens
CSASGTGVSGAFF

SEQ ID NO: 3003 - protein, 15 aa, Homo sapiens
CSASHGSGFTYEQYF

SEQ ID NO: 3004 - protein, 15 aa, Homo sapiens
CSASKSGYPPSEQFF

SEQ ID NO: 3005 - protein, 14 aa, Homo sapiens
CSASPGVGDTEAFF

SEQ ID NO: 3006 - protein, 17 aa, Homo sapiens
CSASPNDDWRAFGGYTF

SEQ ID NO: 3007 - protein, 15 aa, Homo sapiens
CSASPREGLNTEAFF

SEQ ID NO: 3008 - protein, 14 aa, Homo sapiens
CSASPWRSYNEQFF

SEQ ID NO: 3009 - protein, 15 aa, Homo sapiens
CSASRKVLSTDTQYF

SEQ ID NO: 3010 - protein, 16 aa, Homo sapiens
CSASSDSYFSNQPQHF

SEQ ID NO: 3011 - protein, 17 aa, Homo sapiens
CSASTIVGLAGAYEQFF

SEQ ID NO: 3012 - protein, 16 aa, Homo sapiens
CSASTPTSGGTDTQYF

SEQ ID NO: 3013 - protein, 16 aa, Homo sapiens
CSASTSPVGGLDEQYF

SEQ ID NO: 3014 - protein, 21 aa, Homo sapiens
CSATETGTSGSWEEPVETQYF

SEQ ID NO: 3015 - protein, 15 aa, Homo sapiens
CSATGESSYNSPLHF

SEQ ID NO: 3016 - protein, 13 aa, Homo sapiens
CSATGTLSDEQFF

SEQ ID NO: 3017 - protein, 16 aa, Homo sapiens
CSATPGGPSSYNEQFF

SEQ ID NO: 3018 - protein, 16 aa, Homo sapiens
CSATPTSTQVPYEQYF

SEQ ID NO: 3019 - protein, 13 aa, Homo sapiens
CSATQRSYEQYFF

SEQ ID NO: 3020 - protein, 15 aa, Homo sapiens
CSATSGTTGAYEQYF

SEQ ID NO: 3021 - protein, 17 aa, Homo sapiens
CSATSPLGALEDREQYF

SEQ ID NO: 3022 - protein, 12 aa, Homo sapiens
CSATTKPHEQYF

SEQ ID NO: 3023 - protein, 13 aa, Homo sapiens
CSAVGLGEETQYF

SEQ ID NO: 3024 - protein, 16 aa, Homo sapiens
CSAWGHQGAGHAEQFF

SEQ ID NO: 3025 - protein, 17 aa, Homo sapiens
CSAWRGTGGPTSREQFF

SEQ ID NO: 3026 - protein, 16 aa, Homo sapiens
CSCEGEGLAGGSEQYF

SEQ ID NO: 3027 - protein, 11 aa, Homo sapiens
CSDPSRETQYF

SEQ ID NO: 3028 - protein, 14 aa, Homo sapiens
CSGAGRRTQETQYF

SEQ ID NO: 3029 - protein, 14 aa, Homo sapiens
CSGRSQGLRETQYF

SEQ ID NO: 3030 - protein, 13 aa, Homo sapiens
CSSLGRNYNEQFF

SEQ ID NO: 3031 - protein, 13 aa, Homo sapiens
CSTPGAGGSEQYF

SEQ ID NO: 3032 - protein, 15 aa, Homo sapiens
CSVLSPSSFVNIQYF

SEQ ID NO: 3033 - protein, 13 aa, Homo sapiens
CTTKAKLQGEQFF

SEQ ID NO: 3034 - protein, 17 aa, Homo sapiens
CASSFNNSRSGGRGYTF

SEQ ID NO: 3035 - protein, 16 aa, Homo sapiens
CASSHPGQPITYEQYF

SEQ ID NO: 3036 - protein, 15 aa, Homo sapiens
CASSHQDRGPTEAFF

SEQ ID NO: 3037 - protein, 16 aa, Homo sapiens
CASSPPGVRAKNIQYF

SEQ ID NO: 3038 - protein, 16 aa, Homo sapiens
CASSQRTESGANVLTF

SEQ ID NO: 3039 - protein, 20 aa, Homo sapiens
CASSQSTFTSGSHTTGELFF

SEQ ID NO: 3040 - protein, 17 aa, Homo sapiens
CATGDPEGQKNTGELFF

SEQ ID NO: 3041 - protein, 11 aa, Homo sapiens
CATGSGNEQYF

SEQ ID NO: 3042 - protein, 15 aa, Homo sapiens
CATISSGSSYNEQFF

SEQ ID NO: 3043 - protein, 12 aa, Homo sapiens
CATMGTGGEAFF

SEQ ID NO: 3044 - protein, 11 aa, Homo sapiens
CATMTGNEQFF

SEQ ID NO: 3045 - protein, 16 aa, Homo sapiens
CATRTIAGDPYNEQFF

SEQ ID NO: 3046 - protein, 12 aa, Homo sapiens
CATSAGAGELFF

SEQ ID NO: 3047 - protein, 15 aa, Homo sapiens
CATSAPGGYGETQYF

SEQ ID NO: 3048 - protein, 13 aa, Homo sapiens
CATSDFRGDEQFF

SEQ ID NO: 3049 - protein, 16 aa, Homo sapiens
CATSDFRTGDTGELFF

SEQ ID NO: 3050 - protein, 15 aa, Homo sapiens
CATSDLDSRQETQYF

SEQ ID NO: 3051 - protein, 17 aa, Homo sapiens
CATSDLPEGSNGNTIYF

SEQ ID NO: 3052 - protein, 14 aa, Homo sapiens
CATSDLQGDQPQHF

SEQ ID NO: 3053 - protein, 17 aa, Homo sapiens
CATSDLQLAGGSDELFF

SEQ ID NO: 3054 - protein, 14 aa, Homo sapiens
CATSDLSSTDTQYF

SEQ ID NO: 3055 - protein, 16 aa, Homo sapiens
CATSDLTGASTDTQYF

SEQ ID NO: 3056 - protein, 14 aa, Homo sapiens
CATSDLTPGGTEAF

SEQ ID NO: 3057 - protein, 13 aa, Homo sapiens
CATSDLWGGEQFF

SEQ ID NO: 3058 - protein, 17 aa, Homo sapiens
CATSDPEGQKNTGELFF

SEQ ID NO: 3059 - protein, 17 aa, Homo sapiens
CATSDPPRGADTGELFF

SEQ ID NO: 3060 - protein, 14 aa, Homo sapiens
CATSDPRAGVVQYF

SEQ ID NO: 3061 - protein, 14 aa, Homo sapiens
CATSDPSGGVEQFF

SEQ ID NO: 3062 - protein, 18 aa, Homo sapiens
CATSDPYLPGLAKNIQYF

SEQ ID NO: 3063 - protein, 15 aa, Homo sapiens
CATSDQQGSYNEQFF

SEQ ID NO: 3064 - protein, 16 aa, Homo sapiens
CATSDQTSGVTGELFF

SEQ ID NO: 3065 - protein, 15 aa, Homo sapiens
CATSDRRTSTDTQYF

SEQ ID NO: 3066 - protein, 16 aa, Homo sapiens
CATSDSGGRKYTEHFF

SEQ ID NO: 3067 - protein, 17 aa, Homo sapiens
CATSDSGMREPTDTQYF

SEQ ID NO: 3068 - protein, 14 aa, Homo sapiens
CATSDSHQSHEQYF

SEQ ID NO: 3069 - protein, 15 aa, Homo sapiens
CATSDSSGREYNEQF

SEQ ID NO: 3070 - protein, 15 aa, Homo sapiens
CATSDTESLTNTQYF

SEQ ID NO: 3071 - protein, 15 aa, Homo sapiens
CATSEGRGYVGELFF

SEQ ID NO: 3072 - protein, 16 aa, Homo sapiens
CATSEREMGQTNEQFF

SEQ ID NO: 3073 - protein, 14 aa, Homo sapiens
CATSERTATHEQYF

SEQ ID NO: 3074 - protein, 15 aa, Homo sapiens
CATSFRTPEGNTQYF

SEQ ID NO: 3075 - protein, 13 aa, Homo sapiens
CATSGEVATEAFF

SEQ ID NO: 3076 - protein, 16 aa, Homo sapiens
CATSPGQGAVTGELFF

SEQ ID NO: 3077 - protein, 14 aa, Homo sapiens
CATTAGDYNNEQFF

SEQ ID NO: 3078 - protein, 13 aa, Homo sapiens
CASAVAVNTEAFF

SEQ ID NO: 3079 - protein, 12 aa, Homo sapiens
CASELAVGELFF

SEQ ID NO: 3080 - protein, 11 aa, Homo sapiens
CASGQGVRQYF

SEQ ID NO: 3081 - protein, 13 aa, Homo sapiens
CASRMGYSGELFF

SEQ ID NO: 3082 - protein, 14 aa, Homo sapiens
CASSAQGELYEQYF

SEQ ID NO: 3083 - protein, 13 aa, Homo sapiens
CASSATEFDEQFF

SEQ ID NO: 3084 - protein, 16 aa, Homo sapiens
CASSEAAGGVGETQYF

SEQ ID NO: 3085 - protein, 13 aa, Homo sapiens
CASSETVGHGYTF

SEQ ID NO: 3086 - protein, 17 aa, Homo sapiens
CASSEYEDASSYNEQFF

SEQ ID NO: 3087 - protein, 18 aa, Homo sapiens
CASSEYKAPKAQDDTQYF

SEQ ID NO: 3088 - protein, 15 aa, Homo sapiens
CASSEYSWRTDTQYF

SEQ ID NO: 3089 - protein, 14 aa, Homo sapiens
CASSFSGSYNEQFF

SEQ ID NO: 3090 - protein, 12 aa, Homo sapiens
CASSLGGYEQYF

SEQ ID NO: 3091 - protein, 11 aa, Homo sapiens
CASSVGDEQYF

SEQ ID NO: 3092 - protein, 11 aa, Homo sapiens
CASTMGDEQFF

SEQ ID NO: 3093 - protein, 11 aa, Homo sapiens
CASTPGDTQYF

SEQ ID NO: 3094 - protein, 15 aa, Homo sapiens
CASRLFLGCHNEQFF

SEQ ID NO: 3095 - protein, 15 aa, Homo sapiens
CAARIHPSPYNDHFF

SEQ ID NO: 3096 - protein, 14 aa, Homo sapiens
CAARLQGANYEEYF

SEQ ID NO: 3097 - protein, 15 aa, Homo sapiens
CAQQGPLLWHTEAFF

SEQ ID NO: 3098 - protein, 17 aa, Homo sapiens
CASERREASVAYNEQFF

SEQ ID NO: 3099 - protein, 14 aa, Homo sapiens
CASFPGGADTEAFF

SEQ ID NO: 3100 - protein, 15 aa, Homo sapiens
CASGHGLPSTDTQYF

SEQ ID NO: 3101 - protein, 13 aa, Homo sapiens
CASGLRASSEQYF

SEQ ID NO: 3102 - protein, 10 aa, Homo sapiens
CASGWKLQYF

SEQ ID NO: 3103 - protein, 12 aa, Homo sapiens
CASKTGTYEQYF

SEQ ID NO: 3104 - protein, 13 aa, Homo sapiens
CASKVGPPYEQYF

SEQ ID NO: 3105 - protein, 14 aa, Homo sapiens
CASLGGPPGETQYF

SEQ ID NO: 3106 - protein, 14 aa, Homo sapiens
CASNLGTFGDSRYF

SEQ ID NO: 3107 - protein, 13 aa, Homo sapiens
CASRDQGGDIQYF

SEQ ID NO: 3108 - protein, 13 aa, Homo sapiens
CASRDRTDEGQYF

SEQ ID NO: 3109 - protein, 11 aa, Homo sapiens
CASRGGGELFF

SEQ ID NO: 3110 - protein, 15 aa, Homo sapiens
CASRIQPSPYNEQFF

SEQ ID NO: 3111 - protein, 13 aa, Homo sapiens
CASRKTRRYGYTF

SEQ ID NO: 3112 - protein, 13 aa, Homo sapiens
CASRLAGVNEQYF

SEQ ID NO: 3113 - protein, 14 aa, Homo sapiens
CASRLLAGAYEQYF

SEQ ID NO: 3114 - protein, 13 aa, Homo sapiens
CASRTGSLGEQYF

SEQ ID NO: 3115 - protein, 13 aa, Homo sapiens
CASRTGVVNEQFF

SEQ ID NO: 3116 - protein, 15 aa, Homo sapiens
CASRTSTSPYHDQFF

SEQ ID NO: 3117 - protein, 15 aa, Homo sapiens
CASSDGQVSNQPQHF

SEQ ID NO: 3118 - protein, 14 aa, Homo sapiens
CASSDRPGVDGYTF

SEQ ID NO: 3119 - protein, 13 aa, Homo sapiens
CASSFGQGYGYTF

SEQ ID NO: 3120 - protein, 13 aa, Homo sapiens
CASSFGRGTEAFF

SEQ ID NO: 3121 - protein, 15 aa, Homo sapiens
CASSFGTSVSYEQYF

SEQ ID NO: 3122 - protein, 14 aa, Homo sapiens
CASSFLGDNYGYTF

SEQ ID NO: 3123 - protein, 15 aa, Homo sapiens
CASSFPGQGYNEQFF

SEQ ID NO: 3124 - protein, 13 aa, Homo sapiens
CASSFSDDNEQFF

SEQ ID NO: 3125 - protein, 13 aa, Homo sapiens
CASSFTGVHEQFF

SEQ ID NO: 3126 - protein, 16 aa, Homo sapiens
CASSFTLGTGGNEQYF

SEQ ID NO: 3127 - protein, 14 aa, Homo sapiens
CASSFVTGGQPQHF

SEQ ID NO: 3128 - protein, 12 aa, Homo sapiens
CASSGLDYEQYF

SEQ ID NO: 3129 - protein, 13 aa, Homo sapiens
CASSGYSGDEQYF

SEQ ID NO: 3130 - protein, 14 aa, Homo sapiens
CASSHWTGESEQYF

SEQ ID NO: 3131 - protein, 16 aa, Homo sapiens
CASSIGTGGPQETQYF

SEQ ID NO: 3132 - protein, 15 aa, Homo sapiens
CASSIRRGGGETQYF

SEQ ID NO: 3133 - protein, 14 aa, Homo sapiens
CASSISGRGNEQFF

SEQ ID NO: 3134 - protein, 13 aa, Homo sapiens
CASSLAGGYEQYF

SEQ ID NO: 3135 - protein, 16 aa, Homo sapiens
CASSLAGLARWETQYF

SEQ ID NO: 3136 - protein, 17 aa, Homo sapiens
CASSLEEAGVARNEQFF

SEQ ID NO: 3137 - protein, 15 aa, Homo sapiens
CASSLFAGSYNEQFF

SEQ ID NO: 3138 - protein, 12 aa, Homo sapiens
CASSLFDNEQFF

SEQ ID NO: 3139 - protein, 16 aa, Homo sapiens
CASSLFGAGGGNEQFF

SEQ ID NO: 3140 - protein, 13 aa, Homo sapiens
CASSLFLSGELFF

SEQ ID NO: 3141 - protein, 13 aa, Homo sapiens
CASSLFRGYEQFF

SEQ ID NO: 3142 - protein, 22 aa, Homo sapiens
CASSLFSPGVGTSVGRGDTQYF

SEQ ID NO: 3143 - protein, 15 aa, Homo sapiens
CASSLGALYENIHYF

SEQ ID NO: 3144 - protein, 13 aa, Homo sapiens
CASSLGATGELFF

SEQ ID NO: 3145 - protein, 13 aa, Homo sapiens
CASSLGFTDTQYF

SEQ ID NO: 3146 - protein, 13 aa, Homo sapiens
CASSLGSVTEQYF

SEQ ID NO: 3147 - protein, 14 aa, Homo sapiens
CASSLISGNYEQYF

SEQ ID NO: 3148 - protein, 15 aa, Homo sapiens
CASSLKDRGSYEQYF

SEQ ID NO: 3149 - protein, 18 aa, Homo sapiens
CASSLLSFGGRAGDEQFF

SEQ ID NO: 3150 - protein, 18 aa, Homo sapiens
CASSLLSFGGRAGNEQFF

SEQ ID NO: 3151 - protein, 13 aa, Homo sapiens
CASSLNRKETQYF

SEQ ID NO: 3152 - protein, 13 aa, Homo sapiens
CASSLQANQPQHF

SEQ ID NO: 3153 - protein, 15 aa, Homo sapiens
CASSLQGDTTYEQYF

SEQ ID NO: 3154 - protein, 15 aa, Homo sapiens
CASSLRAPSSYEQYF

SEQ ID NO: 3155 - protein, 13 aa, Homo sapiens
CASSLRESYEQYF

SEQ ID NO: 3156 - protein, 14 aa, Homo sapiens
CASSLRGATDTQYF

SEQ ID NO: 3157 - protein, 13 aa, Homo sapiens
CASSLSAGGGYTF

SEQ ID NO: 3158 - protein, 16 aa, Homo sapiens
CASSLSDRGRSNEQFF

SEQ ID NO: 3159 - protein, 13 aa, Homo sapiens
CASSLSGANVLTF

SEQ ID NO: 3160 - protein, 14 aa, Homo sapiens
CASSLSGGTYEQYF

SEQ ID NO: 3161 - protein, 16 aa, Homo sapiens
CASSLSLGLAGIEQFF

SEQ ID NO: 3162 - protein, 16 aa, Homo sapiens
CASSLSLLGNDNEQFF

SEQ ID NO: 3163 - protein, 16 aa, Homo sapiens
CASSLSPSGSSNTQYF

SEQ ID NO: 3164 - protein, 15 aa, Homo sapiens
CASSLSRGLLNEQFF

SEQ ID NO: 3165 - protein, 15 aa, Homo sapiens
CASSLSRGSLYEQYF

SEQ ID NO: 3166 - protein, 15 aa, Homo sapiens
CASSLSRTGSSEAFF

SEQ ID NO: 3167 - protein, 14 aa, Homo sapiens
CASSLSSPLNEQFF

SEQ ID NO: 3168 - protein, 16 aa, Homo sapiens
CASSLSWGSPQNEQFF

SEQ ID NO: 3169 - protein, 14 aa, Homo sapiens
CASSLTLGGYEQFF

SEQ ID NO: 3170 - protein, 14 aa, Homo sapiens
CASSLTSGTYEQYF

SEQ ID NO: 3171 - protein, 16 aa, Homo sapiens
CASSLVSLAGEYEQYF

SEQ ID NO: 3172 - protein, 15 aa, Homo sapiens
CASSLWDGTMDTQYF

SEQ ID NO: 3173 - protein, 15 aa, Homo sapiens
CASSLWGAGANVLTF

SEQ ID NO: 3174 - protein, 13 aa, Homo sapiens
CASSLYPQGKLFF

SEQ ID NO: 3175 - protein, 15 aa, Homo sapiens
CASSLYSGGSGEQYF

SEQ ID NO: 3176 - protein, 15 aa, Homo sapiens
CASSPDSLLYNEQFF

SEQ ID NO: 3177 - protein, 13 aa, Homo sapiens
CASSPFLSGELYF

SEQ ID NO: 3178 - protein, 16 aa, Homo sapiens
CASSPGASGSYNEQFF

SEQ ID NO: 3179 - protein, 14 aa, Homo sapiens
CASSPGQGGYEQYF

SEQ ID NO: 3180 - protein, 13 aa, Homo sapiens
CASSPGTAAEQYF

SEQ ID NO: 3181 - protein, 16 aa, Homo sapiens
CASSPGTGGYYNEQFF

SEQ ID NO: 3182 - protein, 16 aa, Homo sapiens
CASSPGTIDSGNTIYF

SEQ ID NO: 3183 - protein, 16 aa, Homo sapiens
CASSPHPTGSADTQYF

SEQ ID NO: 3184 - protein, 15 aa, Homo sapiens
CASSPLETAGDGYTF

SEQ ID NO: 3185 - protein, 15 aa, Homo sapiens
CASSPLKTAGDGYTF

SEQ ID NO: 3186 - protein, 12 aa, Homo sapiens
CASSPPGKTQYF

SEQ ID NO: 3187 - protein, 16 aa, Homo sapiens
CASSPRGAGGPYEQYF

SEQ ID NO: 3188 - protein, 17 aa, Homo sapiens
CASSPRVPGQVNSPLHF

SEQ ID NO: 3189 - protein, 14 aa, Homo sapiens
CASSPSTGAPEAFF

SEQ ID NO: 3190 - protein, 15 aa, Homo sapiens
CASSPSTGGSQPQHF

SEQ ID NO: 3191 - protein, 15 aa, Homo sapiens
CASSPTAGGRNEQYF

SEQ ID NO: 3192 - protein, 12 aa, Homo sapiens
CASSPYTGELFF

SEQ ID NO: 3193 - protein, 15 aa, Homo sapiens
CASSQTSGTAYEQYF

SEQ ID NO: 3194 - protein, 13 aa, Homo sapiens
CASSRAANYGYTF

SEQ ID NO: 3195 - protein, 14 aa, Homo sapiens
CASSRADPQETQYF

SEQ ID NO: 3196 - protein, 13 aa, Homo sapiens
CASSRGESGELFF

SEQ ID NO: 3197 - protein, 14 aa, Homo sapiens
CASSRQGDTYEQYF

SEQ ID NO: 3198 - protein, 16 aa, Homo sapiens
CASSSDASWGTDTQYF

SEQ ID NO: 3199 - protein, 15 aa, Homo sapiens
CASSSEGQATYEQYF

SEQ ID NO: 3200 - protein, 13 aa, Homo sapiens
CASSSFDSYGYTF

SEQ ID NO: 3201 - protein, 13 aa, Homo sapiens
CASSSGGLNEQFF

SEQ ID NO: 3202 - protein, 13 aa, Homo sapiens
CASSSGRFTEAFF

SEQ ID NO: 3203 - protein, 13 aa, Homo sapiens
CASSSLPLYEAFF

SEQ ID NO: 3204 - protein, 19 aa, Homo sapiens
CASSSQDPGLAGVYNEQFF

SEQ ID NO: 3205 - protein, 15 aa, Homo sapiens
CASSSTGQGNQPQHF

SEQ ID NO: 3206 - protein, 16 aa, Homo sapiens
CASSSWDSGSSYEQYF

SEQ ID NO: 3207 - protein, 13 aa, Homo sapiens
CASSSWDSYEQYF

SEQ ID NO: 3208 - protein, 15 aa, Homo sapiens
CASSSYRGGPYEQYF

SEQ ID NO: 3209 - protein, 12 aa, Homo sapiens
CASSTGLYGYTF

SEQ ID NO: 3210 - protein, 14 aa, Homo sapiens
CASSTGMNTGELFF

SEQ ID NO: 3211 - protein, 20 aa, Homo sapiens
CASSTHRGGNSVDGNQPQHF

SEQ ID NO: 3212 - protein, 17 aa, Homo sapiens
CASSVRRGPKNTGELFF

SEQ ID NO: 3213 - protein, 15 aa, Homo sapiens
CASSWDRGGSQPQHF

SEQ ID NO: 3214 - protein, 14 aa, Homo sapiens
CASSWGRGTGELFF

SEQ ID NO: 3215 - protein, 15 aa, Homo sapiens
CASSWQKRGTDTQYF

SEQ ID NO: 3216 - protein, 15 aa, Homo sapiens
CASSWTSGRVDEQFF

SEQ ID NO: 3217 - protein, 13 aa, Homo sapiens
CASSYFRGNEQFF

SEQ ID NO: 3218 - protein, 13 aa, Homo sapiens
CASSYLKGTEQYF

SEQ ID NO: 3219 - protein, 11 aa, Homo sapiens
CASTDAGELFF

SEQ ID NO: 3220 - protein, 12 aa, Homo sapiens
CASTGGTDTQYF

SEQ ID NO: 3221 - protein, 13 aa, Homo sapiens
CASTSGGTGELFF

SEQ ID NO: 3222 - protein, 15 aa, Homo sapiens
CATRIQPSPYNEHFF

SEQ ID NO: 3223 - protein, 13 aa, Homo sapiens
CATRTGVVNEHFF

SEQ ID NO: 3224 - protein, 16 aa, Homo sapiens
CATSPGTGGYYNDQFF

SEQ ID NO: 3225 - protein, 12 aa, Homo sapiens
CACCFGGPEPFF

SEQ ID NO: 3226 - protein, 11 aa, Homo sapiens
CACFWGGQLFF

SEQ ID NO: 3227 - protein, 15 aa, Homo sapiens
CACQPPEGLSETQYF

SEQ ID NO: 3228 - protein, 13 aa, Homo sapiens
CAIRTSGTDTQYF

SEQ ID NO: 3229 - protein, 13 aa, Homo sapiens
CANKQRDRYQQNF

SEQ ID NO: 3230 - protein, 12 aa, Homo sapiens
CASASNYNEQFF

SEQ ID NO: 3231 - protein, 13 aa, Homo sapiens
CASEGPENTEAFF

SEQ ID NO: 3232 - protein, 16 aa, Homo sapiens
CASFTRVAASGNTIYF

SEQ ID NO: 3233 - protein, 18 aa, Homo sapiens
CASGSGEPPVVGDYEQYF

SEQ ID NO: 3234 - protein, 15 aa, Homo sapiens
CASKLGRQGIETQYF

SEQ ID NO: 3235 - protein, 16 aa, Homo sapiens
CASKQAGGIGTDTQYF

SEQ ID NO: 3236 - protein, 18 aa, Homo sapiens
CASLALGWRTSGTNEQFF

SEQ ID NO: 3237 - protein, 13 aa, Homo sapiens
CASMASGKDEQFF

SEQ ID NO: 3238 - protein, 14 aa, Homo sapiens
CASNRGQSFGEQYF

SEQ ID NO: 3239 - protein, 14 aa, Homo sapiens
CASQSGTSGDEQYF

SEQ ID NO: 3240 - protein, 14 aa, Homo sapiens
CASRATGSGNTIYF

SEQ ID NO: 3241 - protein, 15 aa, Homo sapiens
CASRGTGTAIHEQYF

SEQ ID NO: 3242 - protein, 15 aa, Homo sapiens
CASRIDRASSYEQYF

SEQ ID NO: 3243 - protein, 14 aa, Homo sapiens
CASRIDSSYNEQFF

SEQ ID NO: 3244 - protein, 14 aa, Homo sapiens
CASRPPQGGYGYTF

SEQ ID NO: 3245 - protein, 16 aa, Homo sapiens
CASRRMDRQIAETQYF

SEQ ID NO: 3246 - protein, 13 aa, Homo sapiens
CASRSSGMDEQFF

SEQ ID NO: 3247 - protein, 15 aa, Homo sapiens
CASRTQREANNEQFF

SEQ ID NO: 3248 - protein, 15 aa, Homo sapiens
CASRYFRDRAGELFF

SEQ ID NO: 3249 - protein, 18 aa, Homo sapiens
CASSERKRDKLHTDTQYF

SEQ ID NO: 3250 - protein, 14 aa, Homo sapiens
CASSFDSLNTEAFF

SEQ ID NO: 3251 - protein, 15 aa, Homo sapiens
CASSFFGQGANEQYF

SEQ ID NO: 3252 - protein, 11 aa, Homo sapiens
CASSFGGEQFF

SEQ ID NO: 3253 - protein, 14 aa, Homo sapiens
CASSFGILTYEQYF

SEQ ID NO: 3254 - protein, 16 aa, Homo sapiens
CASSFLAGGSGNEQFF

SEQ ID NO: 3255 - protein, 14 aa, Homo sapiens
CASSFNSGNYGYTF

SEQ ID NO: 3256 - protein, 18 aa, Homo sapiens
CASSFQGQGALFAYEQYF

SEQ ID NO: 3257 - protein, 15 aa, Homo sapiens
CASSFQTGGGTEAFF

SEQ ID NO: 3258 - protein, 15 aa, Homo sapiens
CASSFSRTRTDTQYF

SEQ ID NO: 3259 - protein, 14 aa, Homo sapiens
CASSFWRSGNEQFF

SEQ ID NO: 3260 - protein, 13 aa, Homo sapiens
CASSGTGGYEQYF

SEQ ID NO: 3261 - protein, 15 aa, Homo sapiens
CASSIDREVRYEQYF

SEQ ID NO: 3262 - protein, 10 aa, Homo sapiens
CASSIEEQFF

SEQ ID NO: 3263 - protein, 13 aa, Homo sapiens
CASSLARQNEQYF

SEQ ID NO: 3264 - protein, 15 aa, Homo sapiens
CASSLDRARKETQYF

SEQ ID NO: 3265 - protein, 13 aa, Homo sapiens
CASSLEPLDGYTF

SEQ ID NO: 3266 - protein, 13 aa, Homo sapiens
CASSLEVWGELFF

SEQ ID NO: 3267 - protein, 15 aa, Homo sapiens
CASSLGIAGGYEQFF

SEQ ID NO: 3268 - protein, 12 aa, Homo sapiens
CASSLGRETQYF

SEQ ID NO: 3269 - protein, 15 aa, Homo sapiens
CASSLGTGTYNEQFF

SEQ ID NO: 3270 - protein, 13 aa, Homo sapiens
CASSLGYSYEQYF

SEQ ID NO: 3271 - protein, 15 aa, Homo sapiens
CASSLKKGEIYEQYF

SEQ ID NO: 3272 - protein, 12 aa, Homo sapiens
CASSLLDLEQYF

SEQ ID NO: 3273 - protein, 16 aa, Homo sapiens
CASSLLGRAVSYEQYF

SEQ ID NO: 3274 - protein, 17 aa, Homo sapiens
CASSLLHSASGANVLTF

SEQ ID NO: 3275 - protein, 16 aa, Homo sapiens
CASSLLRDQRGYEQYF

SEQ ID NO: 3276 - protein, 13 aa, Homo sapiens
CASSLNMVYGYTF

SEQ ID NO: 3277 - protein, 12 aa, Homo sapiens
CASSLNTGELFF

SEQ ID NO: 3278 - protein, 11 aa, Homo sapiens
CASSLPGSYTF

SEQ ID NO: 3279 - protein, 15 aa, Homo sapiens
CASSLQGTGWTEAFF

SEQ ID NO: 3280 - protein, 14 aa, Homo sapiens
CASSLQGYPYEQYF

SEQ ID NO: 3281 - protein, 14 aa, Homo sapiens
CASSLSMGSDTQYF

SEQ ID NO: 3282 - protein, 11 aa, Homo sapiens
CASSLTDTQYF

SEQ ID NO: 3283 - protein, 18 aa, Homo sapiens
CASSLTSGGYSSTDTQYF

SEQ ID NO: 3284 - protein, 15 aa, Homo sapiens
CASSLVAGEPYEQYF

SEQ ID NO: 3285 - protein, 13 aa, Homo sapiens
CASSLVLVYEQYF

SEQ ID NO: 3286 - protein, 14 aa, Homo sapiens
CASSLWGSTDTQYF

SEQ ID NO: 3287 - protein, 14 aa, Homo sapiens
CASSLWGTLYEQYF

SEQ ID NO: 3288 - protein, 14 aa, Homo sapiens
CASSMTGTFNEQFF

SEQ ID NO: 3289 - protein, 15 aa, Homo sapiens
CASSPGIDLNQPQHF

SEQ ID NO: 3290 - protein, 13 aa, Homo sapiens
CASSPGLATEQYF

SEQ ID NO: 3291 - protein, 17 aa, Homo sapiens
CASSPMGGLAGVYEQYF

SEQ ID NO: 3292 - protein, 15 aa, Homo sapiens
CASSPPGGGNSPLHF

SEQ ID NO: 3293 - protein, 17 aa, Homo sapiens
CASSPPGTGVLGTEAFF

SEQ ID NO: 3294 - protein, 14 aa, Homo sapiens
CASSPRGTFYGYTF

SEQ ID NO: 3295 - protein, 15 aa, Homo sapiens
CASSPSGTGLETQYF

SEQ ID NO: 3296 - protein, 13 aa, Homo sapiens
CASSPTGSFEQYF

SEQ ID NO: 3297 - protein, 14 aa, Homo sapiens
CASSPTGTKNGYTF

SEQ ID NO: 3298 - protein, 14 aa, Homo sapiens
CASSQTGAAYEQYF

SEQ ID NO: 3299 - protein, 15 aa, Homo sapiens
CASSRGGEDTGELFF

SEQ ID NO: 3300 - protein, 14 aa, Homo sapiens
CASSRIADMNEQFF

SEQ ID NO: 3301 - protein, 15 aa, Homo sapiens
CASSRLRERGETQYF

SEQ ID NO: 3302 - protein, 15 aa, Homo sapiens
CASSSDRVRNQPQHF

SEQ ID NO: 3303 - protein, 14 aa, Homo sapiens
CASSSIGTAYEQYF

SEQ ID NO: 3304 - protein, 16 aa, Homo sapiens
CASSSSGTQNTDTQYF

SEQ ID NO: 3305 - protein, 14 aa, Homo sapiens
CASSSTGFSEKLFF

SEQ ID NO: 3306 - protein, 16 aa, Homo sapiens
CASSSWTSGDTDTQYF

SEQ ID NO: 3307 - protein, 12 aa, Homo sapiens
CASSTVQNEQFF

SEQ ID NO: 3308 - protein, 15 aa, Homo sapiens
CASSWDFSSYNEQFF

SEQ ID NO: 3309 - protein, 12 aa, Homo sapiens
CASSWGGKEQYF

SEQ ID NO: 3310 - protein, 13 aa, Homo sapiens
CASSWGQVSEQYF

SEQ ID NO: 3311 - protein, 14 aa, Homo sapiens
CASSYLAGAYEQYF

SEQ ID NO: 3312 - protein, 15 aa, Homo sapiens
CASTDGLAGAYEQYF

SEQ ID NO: 3313 - protein, 13 aa, Homo sapiens
CASTITENTEAFF

SEQ ID NO: 3314 - protein, 16 aa, Homo sapiens
CASTLGLAGPPYEQYF

SEQ ID NO: 3315 - protein, 15 aa, Homo sapiens
CATRFMAGPTHEQYF

SEQ ID NO: 3316 - protein, 17 aa, Homo sapiens
CATSDPEGQKNTGELFF

SEQ ID NO: 3317 - protein, 15 aa, Homo sapiens
CATSRSGSLTDTQYF

SEQ ID NO: 3318 - protein, 14 aa, Homo sapiens
CSAGTGGTNEKLFF

SEQ ID NO: 3319 - protein, 13 aa, Homo sapiens
CSARQGSAYEQYF

SEQ ID NO: 3320 - protein, 17 aa, Homo sapiens
CSGEGRSTSGGFDEQFF

SEQ ID NO: 3321 - protein, 15 aa, Homo sapiens
CSTRLAGERQETQYF

SEQ ID NO: 3322 - protein, 15 aa, Homo sapiens
CSVADSIGAKNIQYF

SEQ ID NO: 3323 - protein, 13 aa, Homo sapiens
CSVASGTGYEQYF

SEQ ID NO: 3324 - protein, 15 aa, Homo sapiens
CSVDPTGRGQETQYF

SEQ ID NO: 3325 - protein, 12 aa, Homo sapiens
CSVDRGENIQYF

SEQ ID NO: 3326 - protein, 11 aa, Homo sapiens
CSVDRNTEAFF

SEQ ID NO: 3327 - protein, 14 aa, Homo sapiens
CSVDSRGSYNEQFF

SEQ ID NO: 3328 - protein, 14 aa, Homo sapiens
CSVDVQGRTDTQYF

SEQ ID NO: 3329 - protein, 11 aa, Homo sapiens
CSVEAVRTLFF

SEQ ID NO: 3330 - protein, 16 aa, Homo sapiens
CSVEAWERGNTGELFF

SEQ ID NO: 3331 - protein, 16 aa, Homo sapiens
CSVEDGGGSNTGELFF

SEQ ID NO: 3332 - protein, 15 aa, Homo sapiens
CSVEDPLAEVETQYF

SEQ ID NO: 3333 - protein, 14 aa, Homo sapiens
CSVEDPQGNYGYTF

SEQ ID NO: 3334 - protein, 17 aa, Homo sapiens
CSVEDWDSGTAADTQYF

SEQ ID NO: 3335 - protein, 12 aa, Homo sapiens
CSVEETNYEQYF

SEQ ID NO: 3336 - protein, 10 aa, Homo sapiens
CSVEGEEQFF

SEQ ID NO: 3337 - protein, 14 aa, Homo sapiens
CSVEGNGGANVLTF

SEQ ID NO: 3338 - protein, 13 aa, Homo sapiens
CSVEGRLGNTIYF

SEQ ID NO: 3339 - protein, 15 aa, Homo sapiens
CSVEGSGRTYNEQFF

SEQ ID NO: 3340 - protein, 17 aa, Homo sapiens
CSVEGTVDREAWETQYF

SEQ ID NO: 3341 - protein, 11 aa, Homo sapiens
CSVELFNEQYF

SEQ ID NO: 3342 - protein, 13 aa, Homo sapiens
CSVELGGAYEQYF

SEQ ID NO: 3343 - protein, 14 aa, Homo sapiens
CSVETSGRFNEQFF

SEQ ID NO: 3344 - protein, 14 aa, Homo sapiens
CSVEVAGGGETQYF

SEQ ID NO: 3345 - protein, 13 aa, Homo sapiens
CSVEVLGNYGYTF

SEQ ID NO: 3346 - protein, 16 aa, Homo sapiens
CSVEWSEGHSYNEQFF

SEQ ID NO: 3347 - protein, 14 aa, Homo sapiens
CSVGAGGTNEKLFF

SEQ ID NO: 3348 - protein, 14 aa, Homo sapiens
CSVGFRGTGYEQYF

SEQ ID NO: 3349 - protein, 12 aa, Homo sapiens
CSVGGSFYGYTF

SEQ ID NO: 3350 - protein, 12 aa, Homo sapiens
CSVGIVSEGYTF

SEQ ID NO: 3351 - protein, 11 aa, Homo sapiens
CSVGTTYEQYF

SEQ ID NO: 3352 - protein, 11 aa, Homo sapiens
CSVKTGNSYTF

SEQ ID NO: 3353 - protein, 16 aa, Homo sapiens
CSVLGTESSSYNEQFF

SEQ ID NO: 3354 - protein, 12 aa, Homo sapiens
CSVPRLGGELFF

SEQ ID NO: 3355 - protein, 11 aa, Homo sapiens
CSVQDYYEQYF

SEQ ID NO: 3356 - protein, 13 aa, Homo sapiens
CSVQSGYTGELFF

SEQ ID NO: 3357 - protein, 14 aa, Homo sapiens
CSVTDVQFSYEQYF

SEQ ID NO: 3358 - protein, 14 aa, Homo sapiens
CSVVGDSFTDTQYF

SEQ ID NO: 3359 - protein, 12 aa, Homo sapiens
CSVVSGAYEQYF

SEQ ID NO: 3360 - protein, 13 aa, Homo sapiens
CSVWGGGSYEQYF

SEQ ID NO: 3361 - protein, 12 aa, Homo sapiens
CACRDSGNEQFF

SEQ ID NO: 3362 - protein, 12 aa, Homo sapiens
CARGWGNDEQYF

SEQ ID NO: 3363 - protein, 11 aa, Homo sapiens
CAWDGYNEQFF

SEQ ID NO: 3364 - protein, 10 aa, Homo sapiens
CAWGLDTQYF

SEQ ID NO: 3365 - protein, 10 aa, Homo sapiens
CAWGLNTQYF

SEQ ID NO: 3366 - protein, 13 aa, Homo sapiens
CAWKLTGLYEQYF

SEQ ID NO: 3367 - protein, 14 aa, Homo sapiens
CAWNVQAGKETQYF

SEQ ID NO: 3368 - protein, 14 aa, Homo sapiens
CAWRAGTGVNEQFF

SEQ ID NO: 3369 - protein, 11 aa, Homo sapiens
CAWRNSGEQYF

SEQ ID NO: 3370 - protein, 15 aa, Homo sapiens
CAWRTLSGAYNEQFF

SEQ ID NO: 3371 - protein, 13 aa, Homo sapiens
CAWSADMNTEAFF

SEQ ID NO: 3372 - protein, 12 aa, Homo sapiens
CAWSDGGKTQYF

SEQ ID NO: 3373 - protein, 12 aa, Homo sapiens
CAWSEGNHEQFF

SEQ ID NO: 3374 - protein, 14 aa, Homo sapiens
CAWSGDRFQDTQYF

SEQ ID NO: 3375 - protein, 13 aa, Homo sapiens
CAWSGTSYNEQFF

SEQ ID NO: 3376 - protein, 10 aa, Homo sapiens
CAWSGYEQYF

SEQ ID NO: 3377 - protein, 14 aa, Homo sapiens
CAWSKTGTGDEQYF

SEQ ID NO: 3378 - protein, 14 aa, Homo sapiens
CAWSPTSGRNEQFF

SEQ ID NO: 3379 - protein, 14 aa, Homo sapiens
CAWSRDSGTDTQYF

SEQ ID NO: 3380 - protein, 17 aa, Homo sapiens
CAWSSFGGLAGSYEQYF

SEQ ID NO: 3381 - protein, 13 aa, Homo sapiens
CAWSTGGATEAFF

SEQ ID NO: 3382 - protein, 14 aa, Homo sapiens
CAWSVGTGGFEQFF

SEQ ID NO: 3383 - protein, 14 aa, Homo sapiens
CAWSVQAGKETHYF

SEQ ID NO: 3384 - protein, 14 aa, Homo sapiens
CAWSVQAGKETQYF

SEQ ID NO: 3385 - protein, 16 aa, Homo sapiens
CAWSVQGYWEVHYGYT

SEQ ID NO: 3386 - protein, 14 aa, Homo sapiens
CAWSVQPGKETPYF

SEQ ID NO: 3387 - protein, 14 aa, Homo sapiens
CAWSVQSGSHEQFF

SEQ ID NO: 3388 - protein, 13 aa, Homo sapiens
CAWSVSVSLEQYF

SEQ ID NO: 3389 - protein, 16 aa, Homo sapiens
CAWSVTGFPPTGELFF

SEQ ID NO: 3390 - protein, 14 aa, Homo sapiens
CAWSVVGGGNGYPF

SEQ ID NO: 3391 - protein, 14 aa, Homo sapiens
CAWVYRAANTEAFF

SEQ ID NO: 3392 - protein, 16 aa, Homo sapiens
CPSGRGRPGGPETQYF

SEQ ID NO: 3393 - protein, 9 aa, Homo sapiens
CYTWNQMNL

SEQ ID NO: 3394 - DNA, 18 bp, Artificial Sequence
  Description of Artificial Sequence: Synthetic TCR-beta chain constant region specific primer
caccagtgtggccttttg

SEQ ID NO: 3395 - DNA, 23 bp, Artificial Sequence
  Description of Artificial Sequence: Synthetic 3'Cbeta reverse primer
gcttctgatggctcaaacacagc

SEQ ID NO: 3396 - DNA, 24 bp, Artificial Sequence
  Description of Artificial Sequence: Synthetic Vbeta family specific forward primer
ggtcacacagatgggacaggaagt

SEQ ID NO: 3397 - DNA, 24 bp, Artificial Sequence
  Description of Artificial Sequence: Synthetic Vbeta family specific forward primer
cccagactccaaaatacctggtca

SEQ ID NO: 3398 - DNA, 27 bp, Artificial Sequence
  Description of Artificial Sequence: Synthetic Vbeta family specific forward primer
tacgcagacaccaagaacacctggtca

SEQ ID NO: 3399 - DNA, 26 bp, Artificial Sequence
  Description of Artificial Sequence: Synthetic Vbeta family specific forward primer
acagcaagtgactagctgagatgctc

SEQ ID NO: 3400 - DNA, 24 bp, Artificial Sequence
  Description of Artificial Sequence: Synthetic Vbeta family specific forward primer
gtgtcactcagaccccaaaattcc

SEQ ID NO: 3401 - DNA, 24 bp, Artificial Sequence
  Description of Artificial Sequence: Synthetic Vbeta family specific forward primer
gtgtgatccaatttcaggtcatac

SEQ ID NO: 3402 - DNA, 25 bp, Artificial Sequence
  Description of Artificial Sequence: Synthetic Vbeta family specific forward primer
atgtaactcttcaggtgtgatccaa

SEQ ID NO: 3403 - DNA, 26 bp, Artificial Sequence
  Description of Artificial Sequence: Synthetic Vbeta family specific forward primer
acagcaagtgactagctgagatgctc

SEQ ID NO: 3404 - DNA, 24 bp, Artificial Sequence
  Description of Artificial Sequence: Synthetic Vbeta family specific forward primer
ccaagacacaaggtcacagagaca

SEQ ID NO: 3405 - DNA, 27 bp, Artificial Sequence
  Description of Artificial Sequence: Synthetic Vbeta family specific forward primer
cagtctcccagatataagattatagag

SEQ ID NO: 3406 - DNA, 24 bp, Artificial Sequence
  Description of Artificial Sequence: Synthetic Vbeta family specific forward primer
ggtgacagagatgggacaagaagt

SEQ ID NO: 3407 - DNA, 27 bp, Artificial Sequence
  Description of Artificial Sequence: Synthetic Vbeta family specific forward primer
ctgatcaaagaaaagagggaaacagcc

SEQ ID NO: 3408 - DNA, 24 bp, Artificial Sequence
  Description of Artificial Sequence: Synthetic Vbeta family specific forward primer
atagaagctggagttactcagttc

SEQ ID NO: 3409 - DNA, 24 bp, Artificial Sequence
  Description of Artificial Sequence: Synthetic Vbeta family specific forward primer
caagataccaggttacccagtttg

SEQ ID NO: 3410 - DNA, 24 bp, Artificial Sequence
  Description of Artificial Sequence: Synthetic Vbeta family specific forward primer
tgcagaacccaagacacctggtca

SEQ ID NO: 3411 - DNA, 24 bp, Artificial Sequence
  Description of Artificial Sequence: Synthetic Vbeta family specific forward primer
cactcagtccccaaagtacctgtt

SEQ ID NO: 3412 - DNA, 24 bp, Artificial Sequence
  Description of Artificial Sequence: Synthetic Vbeta family specific forward primer
gagtgccgttccctggactttcag

SEQ ID NO: 3413 - DNA, 24 bp, Artificial Sequence
  Description of Artificial Sequence: Synthetic Vbeta family specific forward primer
aaggtcacccagagacctagactt

SEQ ID NO: 3414 - DNA, 24 bp, Artificial Sequence
  Description of Artificial Sequence: Synthetic Vbeta family specific forward primer
acaaagatggattgtacccccgaa

SEQ ID NO: 3415 - DNA, 24 bp, Artificial Sequence
  Description of Artificial Sequence: Synthetic Vbeta family specific forward primer
gttacccagaccccaaggaatagg

SEQ ID NO: 3416 - DNA, 25 bp, Artificial Sequence
  Description of Artificial Sequence: Synthetic Vbeta family specific forward primer
gatcactctggaatgttctcaaacc

SEQ ID NO: 3417 - DNA, 24 bp, Artificial Sequence
  Description of Artificial Sequence: Synthetic Vbeta family specific forward primer
gtgacccagaacccaagatacctc

SEQ ID NO: 3418 - DNA, 24 bp, Artificial Sequence
  Description of Artificial Sequence: Synthetic Vbeta family specific forward primer
gtaacccagagctcgagatatcta

SEQ ID NO: 3419 - DNA, 26 bp, Artificial Sequence
  Description of Artificial Sequence: Synthetic Vbeta family specific forward primer
tccagtgtcaagtccatagccaagtc

SEQ ID NO: 3420 - DNA, 27 bp, Artificial Sequence
  Description of Artificial Sequence: Synthetic Vbeta family specific forward primer
gtcagatctcagactattcatcaatgg

SEQ ID NO: 3421 - DNA, 21 bp, Artificial Sequence
  Description of Artificial Sequence: Synthetic 5'Cbeta reverse primer
ggaacacgtttttcaggtcct

The invention claimed is:

1. A synthesized cDNA, comprising:
   (1) a nucleotide sequence encoding the entire amino acid sequence of a complementarity determining region 3 (CDR3) of a vβ chain of a T-cell receptor (TCR) of a WT1-specific HLA-A*2402-positive cytotoxic T-cell (CTL), wherein the nucleotide sequence is selected from the group consisting of SEQ ID NOs: 1-200, or
   (2) the nucleotide sequence that is complementary to the full length of the nucleotide sequence of (1),
   wherein the cDNA further comprises a label attached to the cDNA, said label selected from fluorescent labels, radioactive labels, enzyme labels, and chromophore labels.

2. The cDNA according to claim 1, wherein said cDNA consists of:
   (1) the nucleotide sequence selected from the group consisting of SEQ ID NOs: 1-200, or
   (2) the nucleotide sequence that is complementary to the full length of the nucleotide sequence of (1): and
   the label.

3. The cDNA according to claim 1, wherein the CDR3 is identified by comparing with a human TCR gene database.

* * * * *